United States Patent
Revenko et al.

(10) Patent No.: US 11,547,718 B2
(45) Date of Patent: Jan. 10, 2023

(54) MODULATORS OF FOXP3 EXPRESSION

(71) Applicant: Ionis Pharmaceuticals, Inc., Carlsbad, CA (US)

(72) Inventors: Alexey Revenko, San Diego, CA (US); Robert A. MacLeod, San Diego, CA (US); Susan M. Freier, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 344 days.

(21) Appl. No.: 16/684,271

(22) Filed: Nov. 14, 2019

(65) Prior Publication Data

US 2020/0179435 A1    Jun. 11, 2020

Related U.S. Application Data

(60) Provisional application No. 62/924,001, filed on Oct. 21, 2019, provisional application No. 62/767,123, filed on Nov. 14, 2018.

(51) Int. Cl.
| | | |
|---|---|---|
| *C07H 21/02* | (2006.01) | |
| *A61K 31/7125* | (2006.01) | |
| *A61P 35/00* | (2006.01) | |
| *C12N 15/113* | (2010.01) | |

(52) U.S. Cl.
CPC .......... *A61K 31/7125* (2013.01); *A61P 35/00* (2018.01); *C12N 15/113* (2013.01); *C12N 2310/11* (2013.01); *C12N 2310/14* (2013.01); *C12N 2310/315* (2013.01); *C12N 2310/3231* (2013.01); *C12N 2310/34* (2013.01); *C12N 2310/344* (2013.01); *C12N 2310/3525* (2013.01)

(58) Field of Classification Search
CPC .......................... C12N 15/113; C12N 2310/11
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,458,066 A | 7/1984 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,668,777 A | 5/1987 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohtsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,278,302 A | 1/1994 | Caruthers et al. |
| 5,286,717 A | 2/1994 | Cohen et al. |
| 5,319,080 A | 6/1994 | Leumann |
| 5,321,131 A | 6/1994 | Agrawal et al. |
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |

(Continued)

FOREIGN PATENT DOCUMENTS

| | | |
|---|---|---|
| CN | 1904900 | 1/2007 |
| EP | 2064350 | 1/2013 |

(Continued)

OTHER PUBLICATIONS

Schubert et al. (J Cytokine Biol, 2018, 3(1), 1-14).*
Kelley et al. (Journal of Biotechnology, 233, 2016, 74-83).*
Barry "Small molecule approaches for immune-oncology" Society for Medicines Research—Immuno-Oncology: The Next Generation of Breakthrough Therapies (presented on Jun. 21, 2019).
Carnevalli et al., "Directly targeting FOXP3 with AZD8701, a first-in-class high affinity antisense oligonucleotide to relieve immunosuppression in cancer" 34th Annual Meeting & Pre-Conference Programs (SITC 2019) Maryland, poster presentation Nov. 8, 2019.
Edbrooke "High-affinity antisense oligonucleotides targeting FOXP3" Oncology IMED, Cambridge UK (2018) agenda only.
Eebrooke "High-affinity antisense oligonucleotides targeting FOXP3" Oncology IMED, Cambridge UK: presented Apr. 10, 2018.

(Continued)

*Primary Examiner* — Amy H Bowman

(57) ABSTRACT

The present embodiments provide methods, compounds, and compositions useful for inhibiting FOXP3 expression, which may be useful for treating, preventing, or ameliorating cancer.

4 Claims, No Drawings

Specification includes a Sequence Listing.

(56) References Cited

U.S. PATENT DOCUMENTS

| | | |
|---|---|---|
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,035 A | 10/1995 | Baum et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddty et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,821,332 A | 10/1998 | Godfrey et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,156,878 A | 12/2000 | Godfrey et al. |
| 6,166,199 A | 12/2000 | Cook et al. |
| 6,242,566 B1 | 6/2001 | Godfrey et al. |
| 6,268,490 B1 | 7/2001 | Imanishi et al. |
| 6,300,319 B1 | 10/2001 | Manoharan |
| 6,312,700 B1 | 11/2001 | Weinberg et al. |
| 6,426,220 B1 | 7/2002 | Bennett et al. |
| 6,525,191 B1 | 2/2003 | Ramasamy |
| 6,528,055 B2 | 3/2003 | Godfrey et al. |
| 6,528,623 B2 | 3/2003 | Godfrey et al. |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,670,461 B1 | 12/2003 | Wengel et al. |
| 6,682,736 B1 | 1/2004 | Hanson et al. |
| 6,770,748 B2 | 8/2004 | Imanishi et al. |
| 6,794,499 B2 | 9/2004 | Wengel et al. |
| 6,906,182 B2 | 6/2005 | Ts'o et al. |
| 7,015,315 B1 | 3/2006 | Cook et al. |
| 7,034,133 B2 | 4/2006 | Wengel et al. |
| 7,053,207 B2 | 5/2006 | Wengel et al. |
| 7,098,184 B2 | 8/2006 | Godfrey et al. |
| 7,101,993 B1 | 9/2006 | Cook et al. |
| 7,109,003 B2 | 9/2006 | Hanson et al. |
| 7,123,281 B2 | 10/2006 | Okada et al. |
| 7,125,670 B2 | 10/2006 | Godfrey et al. |
| 7,250,496 B2 | 7/2007 | Bentwich |
| 7,262,177 B2 | 8/2007 | Ts'o et al. |
| 7,374,927 B2 | 5/2008 | Palma et al. |
| 7,399,845 B2 | 7/2008 | Seth et al. |
| 7,411,057 B2 | 8/2008 | Hanson et al. |
| 7,427,672 B2 | 9/2008 | Imanishi et al. |
| 7,491,805 B2 | 2/2009 | Vargeese et al. |
| 7,504,101 B2 | 3/2009 | Weinberg et al. |
| 7,507,542 B2 | 3/2009 | Khattri et al. |
| 7,521,051 B2 | 4/2009 | Collins et al. |
| 7,547,684 B2 | 6/2009 | Seth et al. |
| 7,569,686 B1 | 8/2009 | Bhat et al. |
| 7,572,582 B2 | 8/2009 | Wengel et al. |
| 7,622,444 B2 | 11/2009 | Weinberg et al. |
| 7,666,854 B2 | 2/2010 | Seth et al. |
| 7,687,616 B1 | 3/2010 | Bentwich et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,807,797 B2 | 10/2010 | Hanson et al. |
| 7,824,679 B2 | 11/2010 | Hanson et al. |
| 7,875,733 B2 | 1/2011 | Bhat et al. |
| 7,888,497 B2 | 2/2011 | Bentwich et al. |
| 7,939,677 B2 | 5/2011 | Bhat et al. |
| 7,943,743 B2 | 5/2011 | Korman et al. |
| 7,959,925 B2 | 6/2011 | Weinberg et al. |
| 8,008,449 B2 | 8/2011 | Korman et al. |
| 8,022,193 B2 | 9/2011 | Swayze et al. |
| 8,030,467 B2 | 10/2011 | Seth et al. |
| 8,034,909 B2 | 10/2011 | Wengel et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,143,379 B2 | 3/2012 | Hanson et al. |
| 8,153,365 B2 | 4/2012 | Wengel et al. |
| 8,158,596 B2 | 4/2012 | Liu et al. |
| 8,178,503 B2 | 5/2012 | Rigoutsos et al. |
| 8,217,149 B2 | 7/2012 | Irving et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |

(56) References Cited

U.S. PATENT DOCUMENTS

| | | | |
|---|---|---|---|
| 8,354,509 B2 | 1/2013 | Carven et al. |
| 8,383,796 B2 | 2/2013 | Korman et al. |
| 8,420,791 B2 | 4/2013 | Ebert et al. |
| 8,440,803 B2 | 5/2013 | Swayze et al. |
| 8,491,895 B2 | 7/2013 | Hanson et al. |
| 8,501,805 B2 | 8/2013 | Seth et al. |
| 8,530,640 B2 | 9/2013 | Seth et al. |
| 8,546,556 B2 | 10/2013 | Seth et al. |
| 8,552,154 B2 | 10/2013 | Freeman et al. |
| 8,598,333 B2 | 12/2013 | Maclachlan et al. |
| RE44,779 E | 2/2014 | Imanishi et al. |
| 8,754,191 B2 | 6/2014 | Nielsen et al. |
| 8,779,108 B2 | 7/2014 | Queva et al. |
| 8,828,956 B2 | 9/2014 | Manoharan et al. |
| 8,946,183 B2 | 2/2015 | Baker et al. |
| 9,005,906 B2 | 4/2015 | Swayze et al. |
| 9,012,421 B2 | 4/2015 | Migawa et al. |
| 9,073,994 B2 | 7/2015 | Honjo et al. |
| 9,102,725 B2 | 8/2015 | Korman et al. |
| 9,102,727 B2 | 8/2015 | Freeman et al. |
| 9,127,276 B2 | 8/2015 | Prakash et al. |
| 9,273,135 B2 | 3/2016 | Korman et al. |
| 9,290,760 B2 | 3/2016 | Rajeev et al. |
| 9,393,301 B2 | 7/2016 | Honjo et al. |
| 9,402,899 B2 | 8/2016 | Honjo et al. |
| 9,439,962 B2 | 9/2016 | Honjo et al. |
| 9,493,565 B2 | 11/2016 | Queva et al. |
| 10,968,426 B2 * | 4/2021 | Meissner ............ A61K 39/001 |
| 2001/0053519 A1 | 12/2001 | Fodor et al. |
| 2003/0082807 A1 | 5/2003 | Wengel |
| 2003/0158403 A1 | 8/2003 | Manoharan et al. |
| 2003/0170648 A1 | 9/2003 | Khattri et al. |
| 2003/0175906 A1 | 9/2003 | Manoharan et al. |
| 2003/0207841 A1 | 11/2003 | Kaneko et al. |
| 2003/0224377 A1 | 12/2003 | Wengel et al. |
| 2003/0228597 A1 | 12/2003 | Cowsert et al. |
| 2004/0143114 A1 | 7/2004 | Imanishi et al. |
| 2004/0171570 A1 | 9/2004 | Allerson et al. |
| 2004/0192918 A1 | 9/2004 | Imanishi et al. |
| 2004/0241651 A1 | 12/2004 | Olek et al. |
| 2005/0048587 A1 | 3/2005 | Rao et al. |
| 2005/0130923 A1 | 6/2005 | Bhat et al. |
| 2006/0148740 A1 | 7/2006 | Platenburg |
| 2006/0153841 A1 | 7/2006 | Freeman et al. |
| 2007/0009955 A1 * | 1/2007 | Bougueleret ......... G01N 33/92 435/7.1 |
| 2007/0031844 A1 | 2/2007 | Khvorova et al. |
| 2007/0243184 A1 | 10/2007 | Fischkoff et al. |
| 2008/0039618 A1 | 2/2008 | Allerson et al. |
| 2008/0070797 A1 | 3/2008 | Mounts |
| 2008/0268457 A1 | 10/2008 | Khvorova et al. |
| 2009/0305972 A1 | 12/2009 | Chahal et al. |
| 2009/0325868 A1 | 12/2009 | Liu et al. |
| 2010/0143359 A1 | 6/2010 | Ebert et al. |
| 2010/0190837 A1 | 7/2010 | Migawa et al. |
| 2010/0197762 A1 | 8/2010 | Swayze et al. |
| 2010/0285039 A1 | 11/2010 | Chen et al. |
| 2011/0054005 A1 | 3/2011 | Naito et al. |
| 2011/0123520 A1 | 5/2011 | Manoharan et al. |
| 2011/0263680 A1 | 10/2011 | Khvorova et al. |
| 2011/0271358 A1 | 11/2011 | Freeman et al. |
| 2012/0039906 A1 | 2/2012 | Olive et al. |
| 2012/0093761 A1 | 4/2012 | Daftarian et al. |
| 2013/0011922 A1 | 1/2013 | Quay et al. |
| 2013/0034559 A1 | 2/2013 | Queva et al. |
| 2013/0130378 A1 | 5/2013 | Manoharan et al. |
| 2013/0203836 A1 | 8/2013 | Rajeev et al. |
| 2014/0044738 A1 | 2/2014 | Langennann et al. |
| 2014/0107330 A1 | 4/2014 | Freier et al. |
| 2015/0018540 A1 | 1/2015 | Prakash et al. |
| 2015/0098942 A1 | 4/2015 | Curti et al. |
| 2015/0099791 A1 | 4/2015 | Krieg et al. |
| 2015/0157710 A1 | 6/2015 | Redmond et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2016/0031990 A1 | 2/2016 | Steele et al. |
| 2016/0122760 A1 | 5/2016 | Barsoum et al. |
| 2016/0137740 A1 | 5/2016 | Hammond et al. |
| 2017/0073689 A1 | 3/2017 | Bhanot et al. |
| 2021/0340536 A1 * | 11/2021 | Aishwarya ............ C12N 15/113 |

FOREIGN PATENT DOCUMENTS

| | | | |
|---|---|---|---|
| WO | WO 2001/077384 | | 10/2001 |
| WO | WO 2002/016656 | | 2/2002 |
| WO | WO 2008/009977 | | 1/2008 |
| WO | WO 2013/173637 | | 11/2013 |
| WO | WO 2013/173645 | | 11/2013 |
| WO | 2014/059238 A2 | | 4/2014 |
| WO | WO 2013/177419 | | 11/2014 |
| WO | 2014/197826 A1 | | 12/2014 |
| WO | WO 2014/197826 | | 12/2014 |
| WO | WO 2014/197826 A1 * | | 12/2014 |
| WO | WO 2015/162422 | | 10/2015 |
| WO | WO 2016/183041 | | 11/2016 |
| WO | WO 2017/181026 | | 10/2017 |
| WO | WO 2018/031871 | | 2/2018 |
| WO | WO 2018/058006 | | 3/2018 |
| WO | WO 2018/078225 | | 5/2018 |
| WO | WO 2019/122277 A1 * | | 6/2019 .......... C12N 15/113 |

OTHER PUBLICATIONS

MacLeod "Discovery and characterization of AZD8701, a high affinity antisense oligonucleotide targeting FOXP3 to relieve immunosuppression in cancer" Oligonucleotide Therapeutics Society (presented on Oct. 15, 2019).

Revenko et al., "High-affinity Antisense Oligonucleotides Targeting Foxp3 Inhibit Immunosuppressive Function of Regulatory T Cells and Produce Anti-tumor Effects in Syngeneic Tumor Models" AACR-NCI-EORTC International Conference on Molecular Targets and Cancer Therapeutics (abstract only) 2017.

Ritchie, et al., "Immuno-oncology: the next generation of breakthrough therapies. Highlights from the Society for Medicines Research Symposium" Drugs fo the Future (2019) 44: 599-604.

Sinclair "Discovery and characterization of AZD8701, a high affinity antisense oligonucleotide targeting FOXP3 to relieve immunosuppression in cancer" AACR Annual Congress—Rational Combinations of Immunotherapy (2019) abstract only.

Sinclair "Discovery and characterization of AZD8701, a high affinity antisense oligonucleotide targeting FOXP3 to relieve immunosuppression in cancer" AACR Annual Congress—Rational Combinations of Immunotherapy: presented Apr. 1, 2019.

Sinclair et al., "High-affinity antisense oligonucleotides targeting FOXP3 inhibit immunosuppressive function of regulatory T cells and produce anti-tumour effects in syngeneic tumour models" AACR, Chicago, IL (2018) abstract only.

Sinclair et al., "High-affinity antisense oligonucleotides targeting FOXP3 inhibit immunosuppressive function of regulatory T cells and produce anti-tumour effects in syngeneic tumour models" AACR, Chicago, IL (Poster Presentation) Apr. 14-18, 2018.

Taylor et al., "Targeting Foxp3 with a high-affinity antisense oligonucleotide inhibits immunosuppressive function of regulatory T cells and produces anti-tumour effects in syngeneic tumour models" Astra-Zeneca-Oxford Cancer Symposium (AZOCS) Keble College Oxford, presented Sep. 13, 2018.

Taylor et al., "OutFoxing immunosuppressive Treg cells by targeting Foxp3 drives anti-tumour effects in syngeneic tumor models" Keystone Poster Presentation on Feb. 21, 2019.

Branch et al., "A good antisense molecule is hard to find," TIBS (1998) 23:45-50.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Crooke et al., "Basic Principles of Antisense Therapeutics" Antisense Research and Application (1998) Chapter 1:1-50.

(56) References Cited

OTHER PUBLICATIONS

Crooke, ST., et al., "Antisense Drug Technology" Second Edition, CRC Press (2008) Chapters 1-28.
Egli, et al., "Synthesis, improved antisense activity and structural rationale for the divergent RNA affinities of 3'-fluoro hexitol nucleic acid (EHNA and Ara-FHNA) modified oligonucleotides." J Am Chem (2011) 133(41):16642-16649.
Gautschi et al., "Activity of a novel bcl-2/bcl-xLbispecific antisense oligonucleotide against tumors of diverse histologic origins" J. Natl. Cancer Inst. (2001) 93:463-471.
Maher et al., "Comparative hybrid arrest by tandem antisense oligodeoxy ribonucleotides or oligodeoxyribonucleoside methylpbosphonates in a cell-free system" Nucl. Acid. Res. (1988) 16(8):3341-3358.
New England Biolabs 1998/99 Catalog (cover page and pp. 121 and 284).
Peter et al., "Antisense oligonucleotides targeting Foxp3 inhibit immunosuppresive function of Tregs in tumours to enhance anti-tumour immunity" BSI Congress 2017, Brighton, UK, poster presentation, Dec. 4-7, 2017.
Reynolds et al., "Rational siRNA design for RNA interference" Nature Biotechnology (2004) 22(3)326-330.
Revenko et al., "High-affinity Antisense Oligonucleotides Targeting Foxp3 Inhibit Immunosuppressive Function of Regulatory T Cells and Produce Anti-tumor Effects in Syngeneic Tumor Models" AACR-NCI-EORTC International Conference on Molecular Targets and Cancer Therapeutics, Poster presentation, Philadelphia, PA, Oct. 26-30, 2017.
Revenko et al., "High-affinity Constrained Ethyl (cEt)-modified Antisense Oligonucleotides Targeting FOXP3 Inhibit Immunosuppressive Functin of Regulatory T Cells and Produce Anti-tumor Effects in Syngeneic Tumor Models" Nature Conference: RNA at the Bench and Bedside, Poster presentation, La Jolla, CA, Oct. 8-10, 2018.
Sanghvi et al., "Heterocyclic Base Modifications in Nucleic Acids and Their Applications in Antisense Oligonucleotides" Antisense Research and Applications (1993) pp. 273-288.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Woolf et al., "Specificity of antisense oligonucleotides in vivo" PNAS (1992) 89: 7305-7309.
International Search Report for PCT/US19/061508 dated Apr. 1, 2020.
Miguel Antonio et al: "Silencing of Foxp3 1-12 enhances the antitumor efficacy of GM-CSF genetically modified tumor cell vaccine against B16 melanoma", Oncotargets and Therapy, vol. 10, Jan. 23, 2017 (Jan. 23, 2017), pp. 503-514.
Revenko Alexey et al: "Direct targeting of FOXP3 in Tregs with AZD8701, a novel antisense oligonucleotide to relieve immunosuppression in cancer", Journal for Immunotherapy of Cancer, vol. 10, No. 4, Apr. 5, 2022 (Apr. 5, 2022), p. e003892.
Astrazeneca: "First Time in Human Study of AZD8701 With or Without Durvalumab in Participants With Advanced Solid Tumours—Full Text View—ClinicalTrials.gov", Clinicaltrials.gov, Jul. 18, 2022 (Jul. 18, 2022), XP055948236, Retrieved from the Internet: URL:https://clinicaltrials.gov/ct2/show/NCT04504669 [retrieved on Aug. 3, 2022].

\* cited by examiner

MODULATORS OF FOXP3 EXPRESSION

SEQUENCE LISTING

The present application is being filed along with a Sequence Listing in electronic format. The Sequence Listing is provided as a file entitled BIOL0344USSEQ_ST25.txt created Nov. 14, 2019, which is 698 kb in size. The information in the electronic format of the sequence listing is incorporated herein by reference in its entirety.

FIELD

The present embodiments provide methods, compounds, and compositions useful for inhibiting FOXP3 expression, which can be useful for treating, preventing, or ameliorating cancer.

BACKGROUND

Foxp3 is a lineage-defining transcription factor for regulatory T cells (Tregs) that controls a restricted set of genes associated with immunosuppression. Tregs suppress immunity (including anti-tumor immunity) via multiple effector mechanisms. The presence of Tregs within the tumor has poor prognostic outcome in multiple types of cancer. Tregs do not possess a known unique surface marker or signalling protein which could enable targeting with biologics. FOXP3 cannot be targeted by monoclonal antibodies or with conventional small molecules.

SUMMARY

Certain embodiments provided herein are directed to potent and tolerable compounds and compositions useful for inhibiting FOXP3 expression, which can be useful for treating, preventing, ameliorating, or slowing progression of cancer. In certain embodiments, the cancer is associated with an immunosuppressive microenvironment or stroma. Certain embodiments are directed to compounds and compositions useful for inhibiting FOXP3 expression in Tregs, which can be useful for treating, preventing, ameliorating, or slowing progression of cancer associated with immunosuppresive Tregs.

DETAILED DESCRIPTION

It is to be understood that both the foregoing general description and the following detailed description are exemplary and explanatory only and are not restrictive of the embodiments, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting.

The section headings used herein are for organizational purposes only and are not to be construed as limiting the subject matter described. All documents, or portions of documents, cited in this application, including, but not limited to, patents, patent applications, articles, books, treatises, and GenBank and NCBI reference sequence records are hereby expressly incorporated by reference for the portions of the document discussed herein, as well as in their entirety.

It is understood that the sequence set forth in each SEQ ID NO in the examples contained herein is independent of any modification to a sugar moiety, an internucleoside linkage, or a nucleobase. As such, compounds defined by a SEQ ID NO may comprise, independently, one or more modifications to a sugar moiety, an internucleoside linkage, or a nucleobase. Compounds described by ION number indicate a combination of nucleobase sequence, chemical modification, and motif.

Unless otherwise indicated, the following terms have the following meanings:

"2'-deoxynucleoside" means a nucleoside comprising 2'-H(H) furanosyl sugar moiety, as found in naturally occurring deoxyribonucleic acids (DNA). In certain embodiments, a 2'-deoxynucleoside may comprise a modified nucleobase or may comprise an RNA nucleobase (uracil).

"2'-O-methoxyethyl" (also 2'-MOE and 2'-O(CH$_2$)$_2$—OCH$_3$) refers to an O-methoxy-ethyl modification at the 2' position of a furanosyl ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" or "2-modified nucleoside" means a nucleoside comprising a 2'-substituted or 2'-modified sugar moiety. As used herein, "2'-substituted" or "2-modified" in reference to a sugar moiety means a sugar moiety comprising at least one 2'-substituent group other than H or OH.

"3' target site" refers to the nucleotide of a target nucleic acid which is complementary to the 3'-most nucleotide of a particular compound.

"5' target site" refers to the nucleotide of a target nucleic acid which is complementary to the 5'-most nucleotide of a particular compound.

"5-methylcytosine" means a cytosine with a methyl group attached to the 5 position.

"About" means within +10% of a value. For example, if it is stated, "the compounds affected about 70% inhibition of FOXP3", it is implied that FOXP3 levels are inhibited within a range of 60% and 80%.

"Administration" or "administering" refers to routes of introducing a compound or composition provided herein to an individual to perform its intended function. An example of a route of administration that can be used includes, but is not limited to parenteral administration, such as subcutaneous, intravenous, or intramuscular injection or infusion.

"Administered concomitantly" or "co-administration" means administration of two or more compounds in any manner in which the pharmacological effects of both are manifest in the patient. Concomitant administration does not require that both compounds be administered in a single pharmaceutical composition, in the same dosage form, by the same route of administration, or at the same time. The effects of both compounds need not manifest themselves at the same time. The effects need only be overlapping for a period of time and need not be coextensive. Concomitant administration or co-administration encompasses administration in parallel or sequentially.

"Amelioration" refers to an improvement or lessening of at least one indicator, sign, or symptom of an associated disease, disorder, or condition. In certain embodiments, amelioration includes a delay or slowing in the progression or severity of one or more indicators of a condition or disease. The progression or severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antibody," as used in this disclosure, refers to an immunoglobulin or a fragment or a derivative thereof, and encompasses any polypeptide comprising an antigen-binding site, regardless of whether it is produced in vitro or in vivo. The term includes, but is not limited to, polyclonal, monoclonal, monospecific, polyspecific, non-specific, humanized, single-chain, chimeric, synthetic, recombinant, hybrid, mutated, and grafted antibodies. Unless otherwise modified by the term "intact," as in "intact antibodies," for the purposes of this disclosure, the term "antibody" also includes antibody fragments such as Fab, F(ab')2, Fv, scFv, Fd, dAb, and other antibody fragments that retain antigen-binding function, i.e., the ability to bind, for example, CTLA-4 or PD-L 1 specifically. Typically, such fragments would comprise an antigen-binding domain.

"Anti-CTLA-4 antibody" refers to an antibody or antigen binding fragment thereof that specifically binds a CTLA-4 polypeptide. Exemplary anti-CTLA-4 antibodies are described for example at U.S. Pat. Nos. 6,682,736; 7,109,003; 7,123,281; 7,411,057; 7,824,679; 8,143,379; 7,807,797; and 8,491,895 (Tremelimumab is 11.2.1, therein), which are herein incorporated by reference. Tremelimumab (U.S. Pat. No. 6,682,736) is an exemplary anti-CTLA-4 antibody.

"Anti-OX40 antibody" refers to an antibody or antigen binding fragment thereof that specifically binds OX40. OX40 antibodies include monoclonal and polyclonal antibodies that are specific for OX40 and antigen-binding fragments thereof. In certain aspects, anti-OX40 antibodies as described herein are monoclonal antibodies (or antigen-binding fragments thereof), e.g., murine, humanized, or fully human monoclonal antibodies. In one particular embodiment, the OX40 antibody is an OX40 receptor agonist, such as the mouse anti-human OX40 monoclonal antibody (9B12) described by Weinberg et al., J Immunother 29, 575-585 (2006). In another embodiment, an OX40 antibody is MEDI0562 as described in US 2016/0137740, incorporated herein by reference. In other embodiments, the antibody which specifically binds to OX40, or an antigen-binding fragment thereof, binds to the same OX40 epitope as mAb 9B12.

"Anti-PD-L 1 antibody" refers to an antibody or antigen binding fragment thereof that specifically binds a PD-L1 polypeptide. Exemplary anti-PD-L1 antibodies are described for example at US2013/0034559, U.S. Pat. Nos. 8,779,108 and 9,493,565 which are herein incorporated by reference. Durvalumab (MEDI4736) is an exemplary anti-PD-L 1 antibody. Other anti-PD-L 1 antibodies include BMS-936559 (Bristol-Myers Squibb) and MPDL3280A (atezolizumab) (Roche).

"Anti-PD-1 antibody" refers to an antibody or antigen binding fragment thereof that specifically binds a PD-1 polypeptide. Exemplary anti-PD-1 antibodies are described for example at U.S. Pat. Nos. 7,521,051; 8,008,449; 8,354,509; 9,073,994; 9,393,301; 9,402,899; and 9,439,962, which are herein incorporated by reference. Exemplary anti-PD-1 antibodies include, without limitation, nivolumab, pembrolizumab, pidilizumab, and AMP-514.

"Antigen-binding domain," "antigen-binding fragment," and "binding fragment" refer to a part of an antibody molecule that comprises amino acids responsible for the specific binding between the antibody and the antigen. In instances, where an antigen is large, the antigen-binding domain may only bind to a part of the antigen. A portion of the antigen molecule that is responsible for specific interactions with the antigen-binding domain is referred to as "epitope" or "antigenic determinant." An antigen-binding domain typically comprises an antibody light chain variable region (VL) and an antibody heavy chain variable region (VH), however, it does not necessarily have to comprise both. For example, a so-called Fd antibody fragment consists only of a VH domain, but still retains some antigen-binding function of the intact antibody. Binding fragments of an antibody are produced by recombinant DNA techniques, or by enzymatic or chemical cleavage of intact antibodies. Binding fragments include Fab, Fab', F(ab')2, Fv, and single-chain antibodies. An antibody other than a "bispecific" or "bifunctional" antibody is understood to have each of its binding sites identical. Digestion of antibodies with the enzyme, papain, results in two identical antigen-binding fragments, known also as "Fab" fragments, and a "Fc" fragment, having no antigen-binding activity but having the ability to crystallize. Digestion of antibodies with the enzyme, pepsin, results in the a F(ab')2 fragment in which the two arms of the antibody molecule remain linked and comprise two-antigen binding sites. The F(ab')2 fragment has the ability to crosslink antigen. "Fv" when used herein refers to the minimum fragment of an antibody that retains both antigen-recognition and antigen-binding sites. "Fab" when used herein refers to a fragment of an antibody that comprises the constant domain of the light chain and the CH1 domain of the heavy chain.

"mAb" refers to monoclonal antibody. Antibodies of the present disclosure comprise without limitation whole native antibodies, bispecific antibodies; chimeric antibodies; Fab, Fab', single chain V region fragments (scFv), fusion polypeptides, and unconventional antibodies.

"Antisense activity" means any detectable and/or measurable activity attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound to the target.

"Antisense compound" means a compound comprising an oligonucleotide and optionally one or more additional features, such as a conjugate group or terminal group. Examples of antisense compounds include single-stranded and double-stranded compounds, such as, oligonucleotides, ribozymes, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means an oligonucleotide having a nucleobase sequence that is complementary to a target nucleic acid or region or segment thereof. In certain embodiments, an antisense oligonucleotide is specifically hybridizable to a target nucleic acid or region or segment thereof.

"Bicyclic nucleoside" or "BNA" means a nucleoside comprising a bicyclic sugar moiety. "Bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

"Branching group" means a group of atoms having at least 3 positions that are capable of forming covalent linkages to at least 3 groups. In certain embodiments, a branching group provides a plurality of reactive sites for connecting tethered ligands to an oligonucleotide via a conjugate linker and/or a cleavable moiety.

"Cell-targeting moiety" means a conjugate group or portion of a conjugate group that is capable of binding to a particular cell type or particular cell types.

"cEt" or "constrained ethyl" means a bicyclic furanosyl sugar moiety comprising a bridge connecting the 4'-carbon and the 2'-carbon, wherein the bridge has the formula: 4'-CH(CH$_3$)—O-2'.

"cEt nucleoside" means a nucleoside comprising a cEt modified sugar moiety.

"Chemical modification" in a compound describes the substitutions or changes through chemical reaction, of any of the units in the compound relative to the original state of such unit. "Modified nucleoside" means a nucleoside having, independently, a modified sugar moiety and/or modified nucleobase. "Modified oligonucleotide" means an oligonucleotide comprising at least one modified internucleoside linkage, a modified sugar, and/or a modified nucleobase.

"Chemically distinct region" refers to a region of a compound that is in some way chemically different than another region of the same compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group of atoms that is cleaved under physiological conditions, for example, inside a cell, an animal, or a human.

"Complementary" in reference to an oligonucleotide means the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine ($^m$C) and guanine (G) unless otherwise specified. Complementary oligonucleotides and/or nucleic acids need not have nucleobase complementarity at each nucleoside and may include one or more nucleobase mismatches. By contrast, "fully complementary" or "100% complementary" in reference to oligonucleotides means that such oligonucleotides have nucleobase matches at each nucleoside without any nucleobase mismatches.

"Conjugate group" means a group of atoms that is attached to an oligonucleotide. Conjugate groups include a conjugate moiety and a conjugate linker that attaches the conjugate moiety to the oligonucleotide.

"Conjugate linker" means a group of atoms comprising at least one bond that connects a conjugate moiety to an oligonucleotide.

"Conjugate moiety" means a group of atoms that is attached to an oligonucleotide via a conjugate linker.

"Contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

"Designing" or "Designed to" refer to the process of designing a compound that specifically hybridizes with a selected nucleic acid molecule.

"Diluent" means an ingredient in a composition that lacks pharmacological activity, but is pharmaceutically necessary or desirable. For example, the diluent in an injected composition can be a liquid, e.g. saline solution.

"Differently modified" means chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

"Dose" means a specified quantity of a compound or pharmaceutical agent provided in a single administration, or in a specified time period. In certain embodiments, a dose may be administered in two or more boluses, tablets, or injections. For example, in certain embodiments, where subcutaneous administration is desired, the desired dose may require a volume not easily accommodated by a single injection. In such embodiments, two or more injections may be used to achieve the desired dose. In certain embodiments, a dose may be administered in two or more injections to minimize injection site reaction in an individual. In other embodiments, the compound or pharmaceutical agent is administered by infusion over an extended period of time or continuously. Doses may be stated as the amount of pharmaceutical agent per hour, day, week or month.

"Dosing regimen" is a combination of doses designed to achieve one or more desired effects.

"Double-stranded antisense compound" means an antisense compound comprising two oligomeric compounds that are complementary to each other and form a duplex, and wherein one of the two said oligomeric compounds comprises an oligonucleotide.

"Effective amount" means the amount of compound sufficient to effectuate a desired physiological outcome in an individual in need of the compound. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to, the products of transcription and translation.

"Gapmer" means an oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Hybridization" means the annealing of oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases. In certain embodiments, complementary nucleic acid molecules include, but are not limited to, an antisense compound and a nucleic acid target. In certain embodiments, complementary nucleic acid molecules include, but are not limited to, an oligonucleotide and a nucleic acid target.

"Immediately adjacent" means there are no intervening elements between the immediately adjacent elements of the same kind (e.g. no intervening nucleobases between the immediately adjacent nucleobases).

"Immune checkpoint inhibitor" means an agent that inhibits the expression or activity of a protein that inhibits an immune response. In one embodiment, an immune checkpoint inhibitor is an agent that inhibits the CTLA-4 or PD-1 pathways. Particular checkpoint inhibitors include antibodies that inhibit PD-1, PD-L1 or CTLA-4.

"Immunomodulatory agent" means an agent that enhances an immune response (e.g., anti-tumor immune response). Exemplary immunomodulatory agents of the present disclosure include antibodies, such as an anti-CTLA-4 antibody, an anti-PD-L 1 antibody, an anti-PD-1 antibody and antigenic fragments of any of these, and OX40 agonists, including proteins, such as OX40 ligand fusion protein, OX40 antibody, or fragments thereof. In one embodiment, the immunomodulatory agent is an immune checkpoint inhibitor.

"Individual" means a human or non-human animal selected for treatment or therapy.

"Inhibiting the expression or activity" refers to a reduction or blockade of the expression or activity relative to the expression of activity in an untreated or control sample and does not necessarily indicate a total elimination of expression or activity.

"Internucleoside linkage" means a group or bond that forms a covalent linkage between adjacent nucleosides in an oligonucleotide. "Modified internucleoside linkage" means any internucleoside linkage other than a naturally occurring, phosphate internucleoside linkage. Non-phosphate linkages are referred to herein as modified internucleoside linkages.

"Lengthened oligonucleotides" are those that have one or more additional nucleosides relative to an oligonucleotide disclosed herein, e.g. a parent oligonucleotide.

"Linked nucleosides" means adjacent nucleosides linked together by an internucleoside linkage.

"Linker-nucleoside" means a nucleoside that links an oligonucleotide to a conjugate moiety. Linker-nucleosides are located within the conjugate linker of a compound. Linker-nucleosides are not considered part of the oligonucleotide portion of a compound even if they are contiguous with the oligonucleotide.

"Mismatch" or "non-complementary" means a nucleobase of a first oligonucleotide that is not complementary to the corresponding nucleobase of a second oligonucleotide or target nucleic acid when the first and second oligonucleotides are aligned. For example, nucleobases including but not limited to a universal nucleobase, inosine, and hypoxanthine, are capable of hybridizing with at least one nucleobase but are still mismatched or non-complementary with respect to nucleobase to which it hybridized. As another example, a nucleobase of a first oligonucleotide that is not capable of hybridizing to the corresponding nucleobase of a second oligonucleotide or target nucleic acid when the first and second oligonucleotides are aligned is a mismatch or non-complementary nucleobase.

"Modulating" refers to changing or adjusting a feature in a cell, tissue, organ or organism. For example, modulating FOXP3 RNA can mean to increase or decrease the level of FOXP3 RNA and/or FOXP3 protein in a cell, tissue, organ or organism. A "modulator" effects the change in the cell, tissue, organ or organism. For example, a FOXP3 compound can be a modulator that decreases the amount of FOXP3 RNA and/or FOXP3 protein in a cell, tissue, organ or organism.

"MOE" means methoxyethyl.

"Monomer" refers to a single unit of an oligomer. Monomers include, but are not limited to, nucleosides and nucleotides.

"Motif" means the pattern of unmodified and/or modified sugar moieties, nucleobases, and/or internucleoside linkages, in an oligonucleotide.

"Natural" or "naturally occurring" means found in nature.

"Non-bicyclic modified sugar" or "non-bicyclic modified sugar moiety" means a modified sugar moiety that comprises a modification, such as a substituent, that does not form a bridge between two atoms of the sugar to form a second ring.

"Nucleic acid" refers to molecules composed of monomeric nucleotides. A nucleic acid includes, but is not limited to, ribonucleic acids (RNA), deoxyribonucleic acids (DNA), single-stranded nucleic acids, and double-stranded nucleic acids.

"Nucleobase" means a heterocyclic moiety capable of pairing with a base of another nucleic acid. As used herein a "naturally occurring nucleobase" is adenine (A), thymine (T), cytosine (C), uracil (U), and guanine (G). A "modified nucleobase" is a naturally occurring nucleobase that is chemically modified. A "universal base" or "universal nucleobase" is a nucleobase other than a naturally occurring nucleobase and modified nucleobase, and is capable of pairing with any nucleobase.

"Nucleobase sequence" means the order of contiguous nucleobases in a nucleic acid or oligonucleotide independent of any sugar or internucleoside linkage.

"Nucleoside" means a compound comprising a nucleobase and a sugar moiety. The nucleobase and sugar moiety are each, independently, unmodified or modified. "Modified nucleoside" means a nucleoside comprising a modified nucleobase and/or a modified sugar moiety. Modified nucleosides include abasic nucleosides, which lack a nucleobase.

"Oligomeric compound" means a compound comprising a single oligonucleotide and optionally one or more additional features, such as a conjugate group or terminal group.

"Oligonucleotide" means a polymer of linked nucleosides each of which can be modified or unmodified, independent one from another. Unless otherwise indicated, oligonucleotides consist of 8-80 linked nucleosides. "Modified oligonucleotide" means an oligonucleotide, wherein at least one sugar, nucleobase, or internucleoside linkage is modified. "Unmodified oligonucleotide" means an oligonucleotide that does not comprise any sugar, nucleobase, or internucleoside modification.

"Parent oligonucleotide" means an oligonucleotide whose sequence is used as the basis of design for more oligonucleotides of similar sequence but with different lengths, motifs, and/or chemistries. The newly designed oligonucleotides may have the same or overlapping sequence as the parent oligonucleotide.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration.

"Pharmaceutically acceptable carrier or diluent" means any substance suitable for use in administering to an individual. For example, a pharmaceutically acceptable carrier can be a sterile aqueous solution, such as PBS or water-for-injection.

"Pharmaceutically acceptable salts" means physiologically and pharmaceutically acceptable salts of compounds, such as oligomeric compounds or oligonucleotides, i.e., salts that retain the desired biological activity of the parent compound and do not impart undesired toxicological effects thereto.

"Pharmaceutical agent" means a compound that provides a therapeutic benefit when administered to an individual.

"Pharmaceutical composition" means a mixture of substances suitable for administering to an individual. For example, a pharmaceutical composition may comprise one or more compounds or salt thereof and a sterile aqueous solution.

"Phosphorothioate linkage" means a modified phosphate linkage in which one of the non-bridging oxygen atoms is replaced with a sulfur atom. A phosphorothioate internucleoside linkage is a modified internucleoside linkage.

"Phosphorus moiety" means a group of atoms comprising a phosphorus atom. In certain embodiments, a phosphorus moiety comprises a mono-, di-, or tri-phosphate, or phosphorothioate.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an oligomeric compound.

"Prevent" refers to delaying or forestalling the onset, development or progression of a disease, disorder, or condition for a period of time from minutes to indefinitely.

"Prodrug" means a compound in a form outside the body which, when administered to an individual, is metabolized to another form within the body or cells thereof. In certain embodiments, the metabolized form is the active, or more active, form of the compound (e.g., drug). Typically conversion of a prodrug within the body is facilitated by the action of an enzyme(s) (e.g., endogenous or viral enzyme) or chemical(s) present in cells or tissues, and/or by physiologic conditions.

"Reduce" means to bring down to a smaller extent, size, amount, or number.

"RefSeq No." is a unique combination of letters and numbers assigned to a sequence to indicate the sequence is for a particular target transcript (e.g., target gene). Such sequence and information about the target gene (collectively, the gene record) can be found in a genetic sequence database. Genetic sequence databases include the NCBI Reference Sequence database, GenBank, the European Nucleotide Archive, and the DNA Data Bank of Japan (the latter three forming the International Nucleotide Sequence Database Collaboration or INSDC).

"Region" is defined as a portion of the target nucleic acid having at least one identifiable structure, function, or characteristic.

"RNAi compound" means an antisense compound that acts, at least in part, through RISC or Ago2, but not through RNase H, to modulate a target nucleic acid and/or protein encoded by a target nucleic acid. RNAi compounds include, but are not limited to double-stranded siRNA, single-stranded RNA (ssRNA), and microRNA, including microRNA mimics.

"Segments" are defined as smaller or sub-portions of regions within a nucleic acid.

"Side effects" means physiological disease and/or conditions attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Single-stranded" in reference to a compound means the compound has only one oligonucleotide.

"Self-complementary" means an oligonucleotide that at least partially hybridizes to itself. A compound consisting of one oligonucleotide, wherein the oligonucleotide of the compound is self-complementary, is a single-stranded compound. A single-stranded compound may be capable of binding to a complementary compound to form a duplex.

"Sites" are defined as unique nucleobase positions within a target nucleic acid.

"Specifically hybridizable" refers to an oligonucleotide having a sufficient degree of complementarity between the oligonucleotide and a target nucleic acid to induce a desired effect, while exhibiting minimal or no effects on non-target nucleic acids. In certain embodiments, specific hybridization occurs under physiological conditions.

"Specifically inhibit" with reference to a target nucleic acid means to reduce or block expression of the target nucleic acid while exhibiting fewer, minimal, or no effects on non-target nucleic acids. Reduction does not necessarily indicate a total elimination of the target nucleic acid's expression.

"Standard cell assay" means assay(s) described in the Examples and reasonable variations thereof.

"Standard in vivo experiment" means the procedure(s) described in the Example(s) and reasonable variations thereof.

"Stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

"Sugar moiety" means an unmodified sugar moiety or a modified sugar moiety. "Unmodified sugar moiety" or "unmodified sugar" means a 2'-OH(H) furanosyl moiety, as found in RNA (an "unmodified RNA sugar moiety"), or a 2'-H(H) moiety, as found in DNA (an "unmodified DNA sugar moiety"). Unmodified sugar moieties have one hydrogen at each of the 1', 3', and 4' positions, an oxygen at the 3' position, and two hydrogens at the 5' position. "Modified sugar moiety" or "modified sugar" means a modified furanosyl sugar moiety or a sugar surrogate. "Modified furanosyl sugar moiety" means a furanosyl sugar comprising a non-hydrogen substituent in place of at least one hydrogen of an unmodified sugar moiety. In certain embodiments, a modified furanosyl sugar moiety is a 2'-substituted sugar moiety. Such modified furanosyl sugar moieties include bicyclic sugars and non-bicyclic sugars.

"Sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary compounds or nucleic acids.

"Synergy" or "synergize" refers to an effect of a combination that is greater than additive of the effects of each component alone at the same doses.

"FOXP3" means any nucleic acid or protein of FOXP3. "FOXP3 nucleic acid" means any nucleic acid encoding FOXP3. For example, in certain embodiments, a FOXP3 nucleic acid includes a DNA sequence encoding FOXP3, an RNA sequence transcribed from DNA encoding FOXP3 (including genomic DNA comprising introns and exons), and an mRNA sequence encoding FOXP3. "FOXP3 mRNA" means an mRNA encoding a FOXP3 protein. The target may be referred to in either upper or lower case.

"FOXP3 specific inhibitor" refers to any agent capable of specifically inhibiting FOXP3 RNA and/or FOXP3 protein expression or activity at the molecular level. For example, FOXP3 specific inhibitors include nucleic acids (including antisense compounds), peptides, antibodies, small molecules, and other agents capable of inhibiting the expression of FOXP3 RNA and/or FOXP3 protein.

"Target gene" refers to a gene encoding a target.

"Targeting" means the specific hybridization of a compound to a target nucleic acid in order to induce a desired effect.

"Target nucleic acid," "target RNA," "target RNA transcript" and "nucleic acid target" all mean a nucleic acid capable of being targeted by compounds described herein.

"Target region" means a portion of a target nucleic acid to which one or more compounds is targeted.

"Target segment" means the sequence of nucleotides of a target nucleic acid to which a compound is targeted. "5' target site" refers to the 5'-most nucleotide of a target segment. "3' target site" refers to the 3'-most nucleotide of a target segment.

"Terminal group" means a chemical group or group of atoms that is covalently linked to a terminus of an oligonucleotide.

"Therapeutically effective amount" means an amount of a compound, pharmaceutical agent, or composition that provides a therapeutic benefit to an individual.

"Treat" refers to administering a compound or pharmaceutical composition to an animal in order to effect an alteration or improvement of a disease, disorder, or condition in the animal.

CERTAIN EMBODIMENTS

Certain embodiments provide methods, compounds and compositions for inhibiting FOXP3 expression.

Certain embodiments provide compounds targeted to a FOXP3 nucleic acid. In certain embodiments, the FOXP3 nucleic acid has the sequence set forth in RefSeq or GEN-BANK Accession No. NM_014009.3 (SEQ ID NO: 1); NT_011568.12_TRUNC_11907130_11921808_COMP (SEQ ID NO: 2); NM_001114377.1 (SEQ ID NO: 3); NC_000023.11_TRUNC_49247001_49273000_COMP (SEQ ID NO: 4); or UCSC Accession No. UC064ZFP.1 corresponding to genomic co-ordinates chrX:49,251,334-49,259,240 on assembly GRCh38/hg38 (SEQ ID NO: 5); each of which is incorporated by reference in its entirety. In certain embodiments, the compound is an antisense compound or oligomeric compound. In certain embodiments, the compound is single-stranded. In certain embodiments, the compound is double-stranded.

Certain embodiments provide a compound comprising a modified oligonucleotide 8 to 80 linked nucleosides in length and having a nucleobase sequence comprising at least 8 contiguous nucleobases of any of the nucleobase sequences of SEQ ID NOs: 9-3246. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 9 to 80 linked nucleosides in length and having a nucleobase sequence comprising at least 9 contiguous nucleobases of any of the nucleobase sequences of SEQ ID NOs: 9-3246. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 10 to 80 linked nucleosides in length and having a nucleobase sequence comprising at least 10 contiguous nucleobases of any of the nucleobase sequences of SEQ ID NOs: 9-3246. In certain embodiments, the compound is an antisense compound or oligomeric compound. In certain embodiments, the compound is single-stranded. In certain embodiments, the compound is double-stranded. In certain embodiments, the modified oligonucleotide is 10 to 30 linked nucleosides in length.

Certain embodiments provide a compound comprising a modified oligonucleotide 11 to 80 linked nucleosides in length and having a nucleobase sequence comprising at least 11 contiguous nucleobases of any of the nucleobase sequences of SEQ ID NOs: 9-3246. In certain embodiments, the compound is an antisense compound or oligomeric compound. In certain embodiments, the compound is single-stranded. In certain embodiments, the compound is double-stranded. In certain embodiments, the modified oligonucleotide is 11 to 30 linked nucleosides in length.

Certain embodiments provide a compound comprising a modified oligonucleotide 12 to 80 linked nucleosides in length and having a nucleobase sequence comprising at least 12 contiguous nucleobases of any of the nucleobase sequences of SEQ ID NOs: 9-3246. In certain embodiments, the compound is an antisense compound or oligomeric compound. In certain embodiments, the compound is single-stranded. In certain embodiments, the compound is double-stranded. In certain embodiments, the modified oligonucleotide is 12 to 30 linked nucleosides in length.

Certain embodiments provide a compound comprising a modified oligonucleotide 16 to 80 linked nucleosides in length and having a nucleobase sequence comprising the nucleobase sequence of any one of SEQ ID NOs: 9-3246. In certain embodiments, the compound is an antisense compound or oligomeric compound. In certain embodiments, the compound is single-stranded. In certain embodiments, the compound is double-stranded. In certain embodiments, the modified oligonucleotide is 16 to 30 linked nucleosides in length.

Certain embodiments provide a compound comprising a modified oligonucleotide consisting of the nucleobase sequence of any one of SEQ ID NOs: 9-3246. In certain embodiments, the compound is an antisense compound or oligomeric compound. In certain embodiments, the compound is single-stranded. In certain embodiments, the compound is double-stranded.

In certain embodiments, a compound comprises a modified oligonucleotide 8 to 80 linked nucleosides in length and having at least an 8, 9, 10, 11, 12, 13, 14, 15, or 16 contiguous nucleobase portion complementary to an equal length portion within nucleotides 2269-2284 of SEQ ID NO: 1. In certain embodiments, the modified oligonucleotide is 10 to 30 linked nucleosides in length. In certain embodiments, the modified oligonucleotide is 16 to 30 linked nucleosides in length.

In certain embodiments, a compound comprises a modified oligonucleotide 8 to 80 linked nucleosides in length and having at least an 8, 9, 10, 11, 12, 13, 14, 15, or 16 contiguous nucleobase portion complementary to an equal length portion within nucleotides 1233-1248, 2156-2171, 2735-2750, 4661-4676, 7307-7322, 7331-7346, 7980-7995, 11581-11596, or 12396-12411 of SEQ ID NO: 2. In certain embodiments, the modified oligonucleotide is 10 to 30 linked nucleosides in length. In certain embodiments, the modified oligonucleotide is 16 to 30 linked nucleosides in length.

In certain embodiments, a compound comprises a modified oligonucleotide 8 to 80 linked nucleosides in length and complementary within nucleotides 2269-2284 of SEQ ID NO: 1. In certain embodiments, the modified oligonucleotide is 10 to 30 linked nucleosides in length. In certain embodiments, the modified oligonucleotide is 16 to 30 linked nucleosides in length.

In certain embodiments, a compound comprises a modified oligonucleotide 8 to 80 linked nucleosides in length and complementary within nucleotides 1233-1248, 2156-2171, 2735-2750, 4661-4676, 7307-7322, 7331-7346, 7980-7995, 11581-11596, or 12396-12411 of SEQ ID NO: 2. In certain embodiments, the modified oligonucleotide is 10 to 30 linked nucleosides in length. In certain embodiments, the modified oligonucleotide is 16 to 30 linked nucleosides in length.

In certain embodiments, a compound comprises a modified oligonucleotide 8 to 80 linked nucleosides in length and having a nucleobase sequence comprising at least an 8, 9, 10, 11, 12, 13, 14, 15, or 16 contiguous nucleobase portion any one of SEQ ID NOs: 449, 501, 544, 794, 1293, 1307, 1511, 1755, 2492, or 2575. In certain embodiments, the modified oligonucleotide is 10 to 30 linked nucleosides in length. In certain embodiments, the modified oligonucleotide is 16 to 30 linked nucleosides in length.

In certain embodiments, a compound comprises a modified oligonucleotide 16 to 80 linked nucleosides in length and having a nucleobase sequence comprising any one of SEQ ID NOs: 449, 501, 544, 794, 1293, 1307, 1511, 1755, 2492, or 2575. In certain embodiments, the modified oligonucleotide is 16 to 30 linked nucleosides in length.

In certain embodiments, a compound comprises a modified oligonucleotide 16 linked nucleosides in length having a nucleobase sequence consisting of any one of SEQ ID NOs: 449, 501, 544, 794, 1293, 1307, 1511, 1755, 2492, or 2575.

In certain embodiments, a compound targeted to FOXP3 is ION 1063734. Out of over 3,000 compounds that were screened as described in the Examples section below, ION 1062428, 1062641, 1062835, 1062937, 1063268, 1063649, 1063655, 1063734, 1064096, or 1064313 emerged as the top lead compounds.

In certain embodiments, any of the foregoing modified oligonucleotides comprises at least one modified internucleoside linkage, at least one modified sugar, and/or at least one modified nucleobase.

In certain embodiments, any of the foregoing modified oligonucleotides comprises at least one modified sugar. In certain embodiments, at least one modified sugar comprises a 2'-O-methoxyethyl group. In certain embodiments, at least one modified sugar is a bicyclic sugar, such as a 4'-CH(CH$_3$)—O-2' group, a 4'-CH$_2$—O-2' group, or a 4'-(CH$_2$)$_2$—O-2' group.

In certain embodiments, the modified oligonucleotide comprises at least one modified internucleoside linkage, such as a phosphorothioate internucleoside linkage.

In certain embodiments, any of the foregoing modified oligonucleotides comprises at least one modified nucleobase, such as 5-methylcytosine.

In certain embodiments, any of the foregoing modified oligonucleotides comprises:
 a gap segment consisting of linked deoxynucleosides;
 a 5' wing segment consisting of linked nucleosides; and
 a 3' wing segment consisting of linked nucleosides;
 wherein the gap segment is positioned between the 5' wing segment and the 3' wing segment and wherein each nucleoside of each wing segment comprises a modified sugar. In certain embodiments, the modified oligonucleotide is 16 to 80 linked nucleosides in length having a nucleobase sequence comprising the sequence recited in any one of SEQ ID NOs: 449, 501, 544, 794, 1293, 1307, 1511, 1755, 2492, or 2575. In certain embodiments, the modified oligonucleotide is 16 to 30 linked nucleosides in length having a nucleobase sequence comprising the sequence recited in any one of SEQ ID NOs: 449, 501, 544, 794, 1293, 1307, 1511, 1755, 2492, or 2575. In certain embodiments, the modified oligonucleotide is 16 linked nucleosides in length having a nucleobase sequence consisting of the sequence recited in any one of SEQ ID NOs: 449, 501, 544, 794, 1293, 1307, 1511, 1755, 2492, or 2575.

In certain embodiments, a compound comprises or consists of a modified oligonucleotide 16-80 linked nucleobases in length having a nucleobase sequence comprising the sequence recited in any one of SEQ ID NOs: 9-3246, wherein the modified oligonucleotide comprises:
 a gap segment consisting of linked deoxynucleosides;
 a 5' wing segment consisting of linked nucleosides; and
 a 3' wing segment consisting of linked nucleosides;
 wherein the gap segment is positioned between the 5' wing segment and the 3' wing segment and wherein each nucleoside of each wing segment comprises a modified sugar. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in any one of SEQ ID NOs: 449, 501, 544, 794, 1293, 1307, 1511, 1755, 2492, or 2575, wherein the modified oligonucleotide comprises:
 a gap segment consisting of linked deoxynucleosides;
 a 5' wing segment consisting of linked nucleosides; and
 a 3' wing segment consisting of linked nucleosides;
 wherein the gap segment is positioned between the 5' wing segment and the 3' wing segment and wherein each nucleoside of each wing segment comprises a modified sugar. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in any one of SEQ ID NOs: 449, 501, 544, 794, 1293, 1307, 1511, 1755, 2492, or 2575, wherein the modified oligonucleotide comprises:

a gap segment consisting often linked deoxynucleosides;

a 5' wing segment consisting of three linked nucleosides; and a 3' wing segment consisting of three linked nucleosides;

wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in SEQ ID NO: 449, wherein the modified oligonucleotide comprises:

a gap segment consisting often linked deoxynucleosides;

a 5' wing segment consisting of three linked nucleosides; and a 3' wing segment consisting of three linked nucleosides;

wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of ION 1063734 or salt thereof, having the following chemical structure:

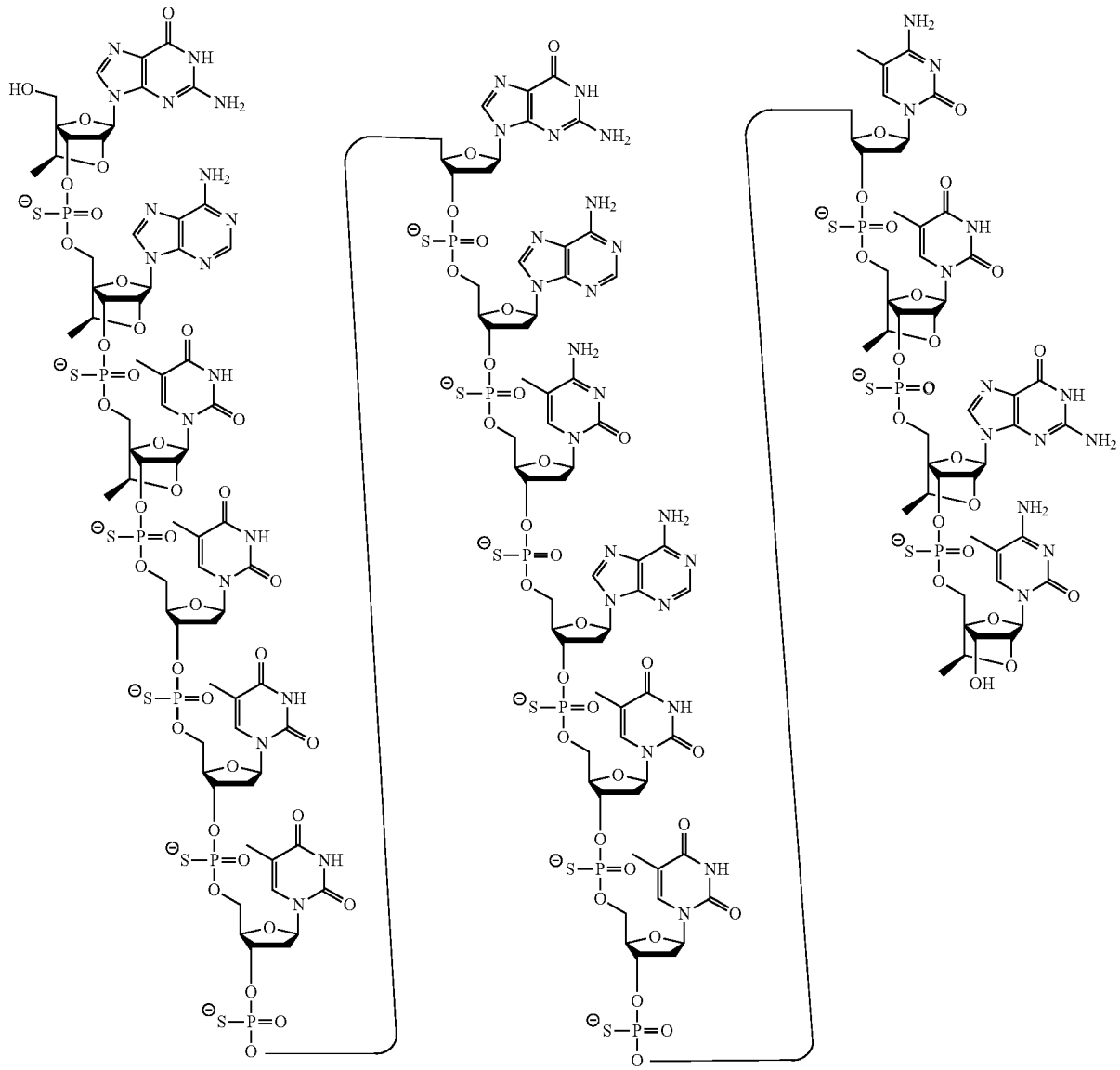

In certain embodiments, a compound comprises or consists of the sodium salt of ION 1063734, having the following chemical structure:

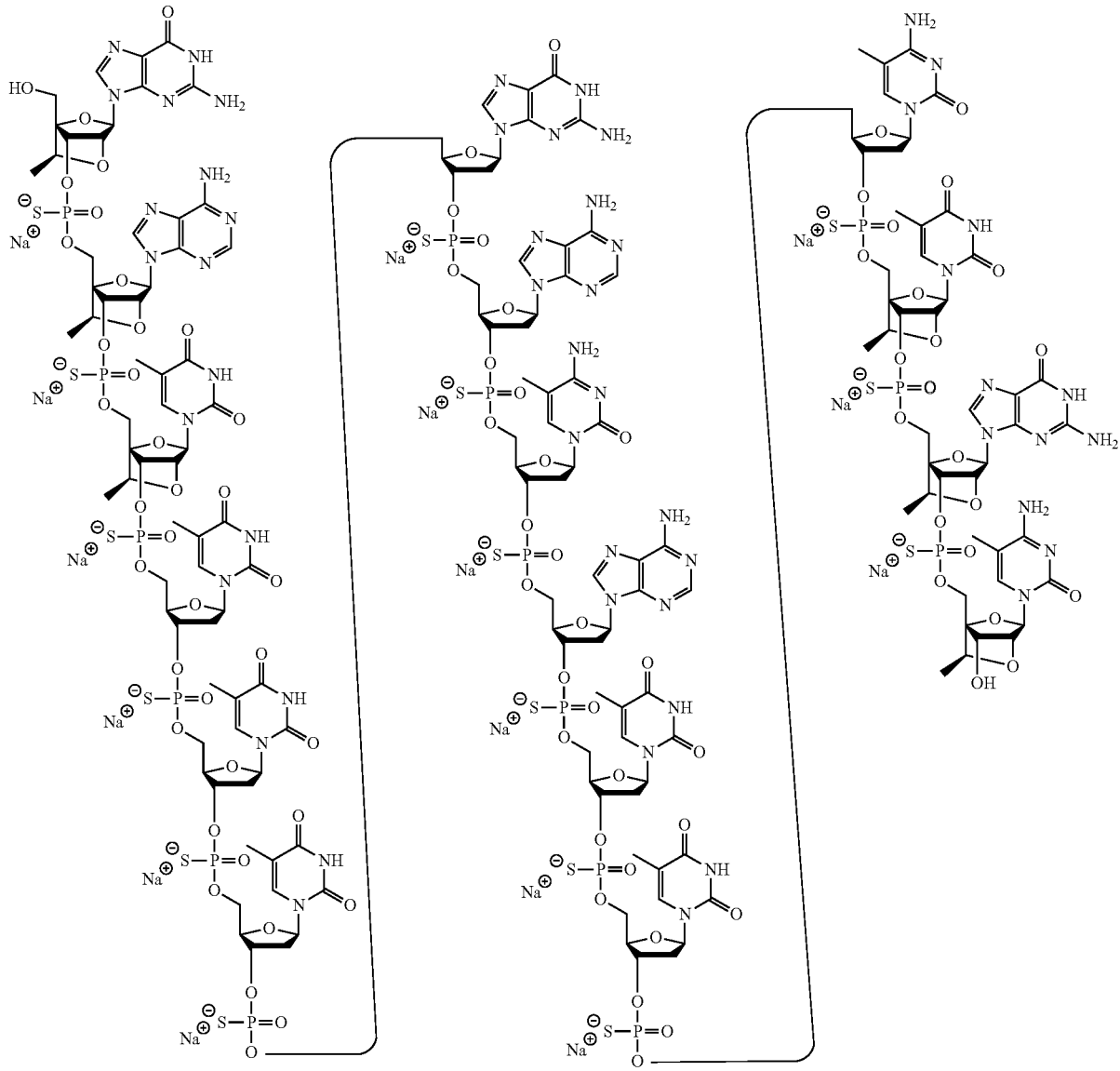

In any of the foregoing embodiments, the compound or oligonucleotide can be at least 85%, at least 90%, at least 95%, at least 98%, at least 99%, or 100% complementary to a nucleic acid encoding FOXP3.

In any of the foregoing embodiments, the compound can be single-stranded. In certain embodiments, the compound comprises deoxyribonucleotides. In certain embodiments, the compound is double-stranded. In certain embodiments, the compound is double-stranded and comprises ribonucleotides. In any of the foregoing embodiments, the compound can be an antisense compound or oligomeric compound.

In any of the foregoing embodiments, the compound can be 8 to 80, 10 to 30, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked nucleosides in length. In certain embodiments, the compound comprises or consists of an oligonucleotide.

In certain embodiments, compounds or compositions provided herein comprise a salt of the modified oligonucleotide. In certain embodiments, the salt is a sodium salt. In certain embodiments, the salt is a potassium salt.

In certain embodiments, the compounds or compositions as described herein are highly tolerable as demonstrated by having at least one of an increase an alanine transaminase (ALT) or aspartate transaminase (AST) value of no more than 4 fold, 3 fold, or 2 fold over saline treated animals or an increase in liver, spleen, or kidney weight of no more than 30%, 20%, 15%, 1²%, 10%, 5%, or 2% compared to control treated animals.

In certain embodiments, the compounds or compositions as described herein are highly tolerable as demonstrated by having no increase of ALT or AST over control treated animals. In certain embodiments, the compounds or compositions as described herein are highly tolerable as demonstrated by having no increase in liver, spleen, or kidney weight over control animals.

Certain embodiments provide a composition comprising the compound of any of the aforementioned embodiments or salt thereof and at least one of a pharmaceutically acceptable carrier or diluent. In certain embodiments, the composition has a viscosity less than about 40 centipoise (cP), less than about 30 centipose (cP), less than about 20 centipose (cP), less than about 15 centipose (cP), or less than about 10 centipose (cP).

In certain embodiments, the composition having any of the aforementioned viscosities comprises a compound provided herein at a concentration of about 100 mg/mL, about 125 mg/mL, about 150 mg/mL, about 175 mg/mL, about 200 mg/mL, about 225 mg/mL, about 250 mg/mL, about 275 mg/mL, or about 300 mg/mL. In certain embodiments, the composition having any of the aforementioned viscosities and/or compound concentrations has a temperature of room temperature or about 20° C., about 21° C., about 22° C., about 23° C., about 24° C., about 25° C., about 26° C., about 27° C., about 28° C., about 29° C., or about 30° C.

Certain Indications

Certain embodiments provided herein relate to methods of inhibiting FOXP3 expression, which can be useful for treating, preventing, or ameliorating cancer in an individual, by administration of a compound that targets FOXP3. In certain embodiments, the compound can be a FOXP3 specific inhibitor. In certain embodiments, the compound can be an antisense compound, oligomeric compound, or oligonucleotide targeted to FOXP3.

Examples of cancers treatable, preventable, and/or ameliorable with the compounds and methods provided herein include cancers with FOXP3 positive (FOXP3+) Tregs in the microenvironment or stroma or tumor draining lymph nodes, lung cancer, non-small cell lung carcinoma (NSCLC), small-cell lung carcinoma (SCLC), squamous cell carcinoma (SCC), head and neck cancer, head and neck squamous cell carcinoma (HNSCC), gastrointestinal cancer, large intestinal cancer, small intestinal cancer, stomach cancer, colon cancer, colorectal cancer, bladder cancer, liver cancer, hepatocellular carcinoma (HCC), esophageal cancer, pancreatic cancer, biliary tract cancer, gastric cancer, urothelial cancer, breast cancer, triple-negative breast cancer (TNBC), ovarian cancer, endometrial cancer, cervical cancer, prostate cancer, mesothelioma, sarcomas (e.g. epitheloid, rhabdoid and synovial), chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL).

In certain embodiments, the B-cell lymphoma is a non-Hodgkin's B-cell lymphoma. Examples of non-Hodgkin's B-cell lymphoma of certain embodiments that can be treated with compounds provided herein include, but are not limited to, diffuse large B cell lymphoma (DLBCL), activated B-cell lymphoma (ABC-DLBCL), germinal center B-cell lymphoma (GCB DLBCL), follicular lymphoma, mucosa-associated lymphatic tissue lymphoma (MALT), small cell lymphocytic lymphoma, chronic lymphocytic leukemia, mantle cell lymphoma (MCL), Burkitt lymphoma, mediastinal large B cell lymphoma, Waldenström macroglobulinemia, nodal marginal zone B cell lymphoma (NMZL), splenic marginal zone lymphoma (SMZL), intravascular large B-cell lymphoma, primary effusion lymphoma, and lymphomatoid granulomatosis.

In certain embodiments, the T-cell lymphoma that can be treated with compounds provided herein include, but are not limited to, peripheral T-cell lymphoma, and anaplastic large cell lymphoma (ALCL).

In certain embodiments, the leukemia that can be treated with compounds provided herein includes, but is not limited to, acute lymphocytic leukemia (ALL).

In certain embodiments, the breast cancer has one or more of the following characteristics: Androgen Receptor positive, dependent on androgen for growth; Estrogen Receptor (ER) negative, independent of estrogen for growth; Progesterone Receptor (PR) negative, independent of progesterone for growth; or Her2/neu negative. In certain embodiments, the breast cancer is ER, PR, and HER2 triple negative (ER−, PR−, HER2−). In certain embodiments, the breast cancer is triple negative and AR positive (ER−, PR−, HER2−, AR+). In certain embodiments, the breast cancer is ER negative and AR positive (ER−, AR+). In certain embodiments, the breast cancer is ER positive and AR positive (ER+, AR+). In certain embodiments, the breast cancer is apocrine. Apocrine breast cancers are often "triple negative", meaning that the cells do not express ER, PR, or HER2 receptors, and usually, but not necessarily, AR positive. In certain embodiments, an apocrine breast cancer is ER, PR, and HER2 triple negative and AR positive (ER−, PR−, HER2−, AR+). In certain embodiments, an apocrine breast cancer is ER negative and AR positive (ER−, AR+). In certain embodiments, an apocrine breast cancer originates from the sweat gland of the breast. In certain embodiments, an apocrine breast cancer is a ductal cancer or cancer cell of the breast. In certain embodiments, an apocrine breast cancer can have any one or more of the following features: a large amount of eosinophilic granular cytoplasm, well-defined margins, large vesicular nuclei, a nuclear to cytoplasmic ratio of about 1:2, and/or accumulations of secreted granules in the apical cytoplasm known as apical snouts. In certain embodiments, the breast cancer is an ER negative and AR positive (ER−, AR+) molecular apocrine breast cancer. In certain aspects, an ER negative and AR positive (ER−, AR+) molecular apocrine breast cancer can further be PR positive, PR negative, HER2 negative, or HER2 positive. In certain embodiments, the breast cancer is HER2 positive. In certain embodiments, the breast cancer is PR positive. In certain embodiments, the breast cancer is ER positive. Breast cancer can be identified as positive or negative with respect to hormone receptors, such as ER, PR, or HER2 by standard histological techniques. For example, in some embodiments histological breast cancer samples can be classified as "triple negative" (ER−, PR−, HER2−) when less than 1% of cells demonstrate nuclear staining for estrogen and progesterone receptors, and immunohistochemical staining for HER2 shows a 0, 1-fold, or a 2-fold positive score and a FISH ratio (HER2 gene signals to chromosome 17 signals) of less than 1.8 according to the relevant ASCO and CAP guidelines. (Meyer, P. et al., PLoS ONE 7(5): e38361 (2012)).

In certain embodiments, a method of treating, preventing, or ameliorating cancer in an individual comprises administering to the individual a compound comprising a FOXP3 specific inhibitor, thereby treating, preventing, or ameliorating the cancer. In certain embodiments, the compound comprises an antisense compound targeted to FOXP3. In certain embodiments, the compound comprises an oligonucleotide targeted to FOXP3. In certain embodiments, a compound comprises a modified oligonucleotide 8 to 80 linked nucleosides in length and having a nucleobase sequence comprising at least 8 contiguous nucleobases of any of the nucleobase sequences of SEQ ID NOs: 9-3246. In certain embodiments, a compound comprises a modified oligonucleotide 16 to 80 linked nucleosides in length and having a nucleobase sequence comprising the nucleobase sequence of any one of SEQ ID NOs: 9-3246. In certain embodiments, a compound comprises a modified oligonucleotide consisting of the nucleobase sequence of any one of SEQ ID NOs: 9-3246. In certain embodiments, a compound comprises a modified oligonucleotide 16 to 80 linked nucleosides in length having a nucleobase sequence comprising any one of SEQ ID NOs: 449, 501, 544, 794, 1293, 1307, 1511, 1755, 2492, or 2575. In certain embodiments, a compound comprises a modified oligonucleotide having a nucleobase sequence consisting of any one of SEQ ID NOs: 449, 501, 544, 794, 1293, 1307, 1511, 1755, 2492, or 2575. In any of the foregoing embodiments, the modified oligonucleotide can be 10 to 30 linked nucleosides in length. In certain embodiments, the compound is ION 1062428, 1062641, 1062835, 1062937, 1063268, 1063649, 1063655, 1063734, 1064096, or 1064313. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces immunosuppression, Treg immunosuppressive activity, cancer cell proliferation, tumor growth, or metastasis. In certain embodiments, administering the compound induces or activates anticancer or antitumor immunity; anticancer or antitumor immune response; immune cell activation or infiltration; inflammatory cell activation or infiltration; effector immune cell activation or infiltration; T cell activation or infiltration; CD8 T cell activation or infiltration; NK cell activation or infiltration; macrophage and dendritic cell activation or infiltration; inflammation; or inflammatory cytokine or chemokine expression.

In certain embodiments, a method of inhibiting expression of FOXP3 in an individual having, or at risk of having, cancer comprises administering to the individual a compound comprising a FOXP3 specific inhibitor, thereby inhibiting expression of FOXP3 in the individual. In certain embodiments, administering the compound inhibits expression of FOXP3 in the Treg cells, tumor microenvironment, tumor stroma, Treg infiltrated tumors, immune cells, lymphoid tissue, lymph nodes, or intra-tumoral Foxp3+ cells. In certain embodiments, the individual has, or is at risk of having a cancer having FOXP3 positive (FOXP3+) Tregs in the microenvironment or stroma or tumor draining lymph nodes, lung cancer, non-small cell lung carcinoma (NSCLC), small-cell lung carcinoma (SCLC), squamous cell carcinoma (SCC), head and neck cancer, head and neck squamous cell carcinoma (HNSCC), gastrointestinal cancer, large intestinal cancer, small intestinal cancer, stomach cancer, colon cancer, colorectal cancer, bladder cancer, liver cancer, hepatocellular carcinoma (HCC), esophageal cancer, pancreatic cancer, biliary tract cancer, gastric cancer, urothelial cancer, breast cancer, triple-negative breast cancer (TNBC), ovarian cancer, endometrial cancer, cervical cancer, prostate cancer, mesothelioma, sarcomas (e.g. epithelioid, rhabdoid and synovial), chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the compound comprises an antisense compound targeted to FOXP3. In certain embodiments, the compound comprises an oligonucleotide targeted to FOXP3.

In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 9-3246. In certain embodiments, the compound comprises a modified oligonucleotide 16 to 80 linked nucleosides in length and having a nucleobase sequence comprising the nucleobase sequence of any one of SEQ ID NOs: 9-3246. In certain embodiments, the compound comprises a modified oligonucleotide consisting of the nucleobase sequence of any one of SEQ ID NOs: 9-3246. In certain embodiments, the compound comprises a modified oligonucleotide of 16 to 80 linked nucleosides in length having a nucleobase sequence comprising any one of SEQ ID NOs: 449, 501, 544, 794, 1293, 1307, 1511, 1755, 2492, or 2575. In certain embodiments, the compound comprises a modified oligonucleotide having a nucleobase sequence consisting of any one of SEQ ID NOs: 449, 501, 544, 794, 1293, 1307, 1511, 1755, 2492, or 2575. In any of the foregoing embodiments, the modified oligonucleotide can be 10 to 30 linked nucleosides in length. In certain embodiments, the compound is ION 1062428, 1062641, 1062835, 1062937, 1063268, 1063649, 1063655, 1063734, 1064096, or 1064313. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, administering the compound inhibits or reduces immunosuppression, Treg immunosuppressive activity, cancer cell proliferation, tumor growth, or metastasis. In certain embodiments, administering the compound induces or activates anticancer or antitumor immunity; anticancer or antitumor immune response;

immune cell activation or infiltration; inflammatory cell activation or infiltration; effector immune cell activation or infiltration; T cell activation or infiltration; CD8 T cell activation or infiltration; NK cell activation or infiltration; macrophage and dendritic cell activation or infiltration; inflammation; or inflammatory cytokine or chemokine expression. In certain embodiments, the individual is identified as having or at risk of having cancer.

In certain embodiments, a method of inhibiting expression of FOXP3 in a cell comprises contacting the cell with a compound comprising a FOXP3 specific inhibitor, thereby inhibiting expression of FOXP3 in the cell. In certain embodiments, the cell is a cancer cell. In certain embodiments, the cell is a Treg cell, tumor microenvironment cell, tumor stroma cell, Treg cell infiltrated in a tumor, immune cell, lymphoid cell, lymph node cell, or intra-tumoral Foxp3+ cell. In certain embodiments, the cell is in the tumor microenvironment, tumor stroma, or lymph node of an individual who has, or is at risk of having cancer. In certain embodiments, the cancer is a cancer that has FOXP3 positive (FOXP3+) Tregs in the microenvironment or stroma or tumor draining lymph nodes, lung cancer, non-small cell lung carcinoma (NSCLC), small-cell lung carcinoma (SCLC), squamous cell carcinoma (SCC), head and neck cancer, head and neck squamous cell carcinoma (HNSCC), gastrointestinal cancer, large intestinal cancer, small intestinal cancer, stomach cancer, colon cancer, colorectal cancer, bladder cancer, liver cancer, hepatocellular carcinoma (HCC), esophageal cancer, pancreatic cancer, biliary tract cancer, gastric cancer, urothelial cancer, breast cancer, triple-negative breast cancer (TNBC), ovarian cancer, endometrial cancer, cervical cancer, prostate cancer, mesothelioma, sarcomas (e.g. epitheloid, rhabdoid and synovial), chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the compound comprises an antisense compound targeted to FOXP3. In certain embodiments, the compound comprises an oligonucleotide targeted to FOXP3. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 9-3246. In certain embodiments, the compound comprises a modified oligonucleotide 16 to 80 linked nucleosides in length and having a nucleobase sequence comprising the nucleobase sequence of any one of SEQ ID NOs: 9-3246. In certain embodiments, the compound comprises a modified oligonucleotide consisting of the nucleobase sequence of any one of SEQ ID NOs: 9-3246. In certain embodiments, the compound comprises a modified oligonucleotide of 16 to 80 linked nucleosides in length having a nucleobase sequence comprising any one of SEQ ID NOs: 449, 501, 544, 794, 1293, 1307, 1511, 1755, 2492, or 2575. In certain embodiments, the compound comprises a modified oligonucleotide having a nucleobase sequence consisting of any one of SEQ ID NOs: 449, 501, 544, 794, 1293, 1307, 1511, 1755, 2492, or 2575. In any of the foregoing embodiments, the modified oligonucleotide can be 10 to 30 linked nucleosides in length. In certain embodiments, the compound is ION 1062428, 1062641, 1062835, 1062937, 1063268, 1063649, 1063655, 1063734, 1064096, or 1064313. In any of the foregoing embodiments, the compound can be single-stranded or double-stranded. In any of the foregoing embodiments, the compound can be an antisense compound or oligomeric compound.

In certain embodiments, a method of reducing or inhibiting immunosuppression, Treg immunosuppressive activity, cancer cell proliferation, tumor growth, or metastasis of an individual having, or at risk of having, cancer comprises administering to the individual a compound comprising a FOXP3 specific inhibitor, thereby reducing or inhibiting immunosuppression, Treg immunosuppressive activity, cancer cell proliferation, tumor growth, or metastasis in the individual. In certain embodiments, a method of inducing or activating anticancer or antitumor immunity; anticancer or antitumor immune response; immune cell activation or infiltration; inflammatory cell activation or infiltration; effector immune cell activation or infiltration; T cell activation or infiltration; CD8 T cell activation or infiltration; NK cell activation or infiltration; macrophage and dendritic cell activation or infiltration; inflammation; or inflammatory cytokine or chemokine expression in an individual having, or at risk of having, cancer comprises administering to the individual a compound comprising a FOXP3 specific inhibitor. In certain embodiments, the individual has, or is at risk of having, a cancer having FOXP3 positive (FOXP3+) Tregs in the microenvironment or stroma or tumor draining lymph nodes, lung cancer, non-small cell lung carcinoma (NSCLC), small-cell lung carcinoma (SCLC), squamous cell carcinoma (SCC), head and neck cancer, head and neck squamous cell carcinoma (HNSCC), gastrointestinal cancer, large intestinal cancer, small intestinal cancer, stomach cancer, colon cancer, colorectal cancer, bladder cancer, liver cancer, hepatocellular carcinoma (HCC), esophageal cancer, pancreatic cancer, biliary tract cancer, gastric cancer, urothelial cancer, breast cancer, triple-negative breast cancer (TNBC), ovarian cancer, endometrial cancer, cervical cancer, prostate cancer, mesothelioma, sarcomas (e.g. epitheloid, rhabdoid and synovial), chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the compound comprises an antisense compound targeted to FOXP3. In certain embodiments, the compound comprises an oligonucleotide targeted to FOXP3. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 9-3246. In certain embodiments, the compound comprises a modified oligonucleotide 16 to 80 linked nucleosides in length and having a nucleobase sequence comprising the nucleobase sequence of any one of SEQ ID NOs: 9-3246. In certain embodiments, the compound comprises a modified oligonucleotide consisting of the nucleobase sequence of any one of SEQ ID NOs: 9-3246. In certain embodiments, the compound comprises a modified oligonucleotide of 16 to 80 linked nucleosides in length having a nucleobase sequence comprising any one of SEQ ID NOs: 449, 501, 544, 794, 1293, 1307, 1511, 1755, 2492, or 2575. In certain embodiments, the compound comprises a modified oligonucleotide having a nucleobase sequence consisting of any one of SEQ ID NOs: 449, 501, 544, 794, 1293, 1307, 1511, 1755, 2492, or 2575. In any of the foregoing embodiments, the modified oligonucleotide can be 10 to 30 linked nucleosides in length. In certain embodiments, the compound is ION 1062428, 1062641, 1062835, 1062937, 1063268, 1063649, 1063655, 1063734, 1064096, or 1064313. In any of the foregoing embodiments, the compound can be single-stranded or double-stranded. In any of the foregoing embodiments, the compound can be an antisense compound or oligomeric compound. In certain embodiments, the compound is administered to the individual parenterally. In certain embodiments, the individual is identified as having or at risk of having cancer.

Certain embodiments are drawn to a compound comprising a FOXP3 specific inhibitor for use in treating cancer. In certain embodiments, the cancer is a cancer having FOXP3 positive (FOXP3+) Tregs in the microenvironment or stroma or tumor draining lymph nodes, lung cancer, non-small cell lung carcinoma (NSCLC), small-cell lung carcinoma (SCLC), squamous cell carcinoma (SCC), head and neck cancer, head and neck squamous cell carcinoma (HNSCC), gastrointestinal cancer, large intestinal cancer, small intestinal cancer, stomach cancer, colon cancer, colorectal cancer, bladder cancer, liver cancer, hepatocellular carcinoma (HCC), esophageal cancer, pancreatic cancer, biliary tract cancer, gastric cancer, urothelial cancer, breast cancer, triple-negative breast cancer (TNBC), ovarian cancer, endometrial cancer, cervical cancer, prostate cancer, mesothelioma, sarcomas (e.g. epitheloid, rhabdoid and synovial), chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the compound comprises an antisense compound targeted to FOXP3. In certain embodiments, the compound comprises an oligonucleotide targeted to FOXP3.

In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 9-3246. In certain embodiments, the compound comprises a modified oligonucleotide 16 to 80 linked nucleosides in length and having a nucleobase sequence comprising the nucleobase sequence of any one of SEQ ID NOs: 9-3246. In certain embodiments, the compound comprises a modified oligonucleotide consisting of the nucleobase sequence of any one of SEQ ID NOs: 9-3246. In certain embodiments, the compound comprises a modified oligonucleotide of 16 to 80 linked nucleosides in length having a nucleobase sequence comprising any one of SEQ ID NOs: 449, 501, 544, 794, 1293, 1307, 1511, 1755, 2492, or 2575. In certain embodiments, the compound comprises a modified oligonucleotide having a nucleobase sequence consisting of any one of SEQ ID NOs: 449, 501, 544, 794, 1293, 1307, 1511, 1755, 2492, or 2575. In any of the foregoing embodiments, the modified oligonucleotide can be 10 to 30 linked nucleosides in length. In certain embodiments, the compound is ION 1062428, 1062641, 1062835, 1062937, 1063268, 1063649, 1063655, 1063734, 1064096, or 1064313. In any of the foregoing embodiments, the compound can be single-stranded or double-stranded. In any of the foregoing embodiments, the compound can be an antisense compound or oligomeric compound.

Certain embodiments are drawn to a compound comprising a FOXP3 specific inhibitor for use in reducing or inhibiting immunosuppression, Treg immunosuppressive activity, cancer cell proliferation, tumor growth, or metastasis in an individual having cancer. Certain embodiments are drawn to a compound comprising a FOXP3 specific inhibitor for use in inducing or activating anticancer or antitumor immunity; anticancer or antitumor immune response; immune cell activation or infiltration; inflammatory cell activation or infiltration; effector immune cell activation or infiltration; T cell activation or infiltration; CD8 T cell activation or infiltration; NK cell activation or infiltration; macrophage and dendritic cell activation or infiltration; inflammation; or inflammatory cytokine or chemokine expression in an individual having cancer.

In certain embodiments, the cancer is a cancer having FOXP3 positive (FOXP3+) Tregs in the microenvironment or stroma or tumor draining lymph nodes, lung cancer, non-small cell lung carcinoma (NSCLC), small-cell lung carcinoma (SCLC), squamous cell carcinoma (SCC), head and neck cancer, head and neck squamous cell carcinoma (HNSCC), gastrointestinal cancer, large intestinal cancer, small intestinal cancer, stomach cancer, colon cancer, colorectal cancer, bladder cancer, liver cancer, hepatocellular carcinoma (HCC), esophageal cancer, pancreatic cancer, biliary tract cancer, gastric cancer, urothelial cancer, breast cancer, triple-negative breast cancer (TNBC), ovarian cancer, endometrial cancer, cervical cancer, prostate cancer, mesothelioma, sarcomas (e.g. epitheloid, rhabdoid and synovial), chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the compound comprises an antisense compound targeted to FOXP3. In certain embodiments, the compound comprises an oligonucleotide targeted to FOXP3.

In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 9-3246. In certain embodiments, the compound comprises a modified oligonucleotide 16 to 80 linked nucleosides in length and having a nucleobase sequence comprising the nucleobase sequence of any one of SEQ ID NOs: 9-3246. In certain embodiments, the compound comprises a modified oligonucleotide consisting of the nucleobase sequence of any one of SEQ ID NOs: 9-3246. In certain embodiments, the compound comprises a modified oligonucleotide of 16 to 80 linked nucleosides in length having a nucleobase sequence comprising any one of SEQ ID NOs: 449, 501, 544, 794, 1293, 1307, 1511, 1755, 2492, or 2575. In certain embodiments, the compound comprises a modified oligonucleotide having a nucleobase sequence consisting of any one of SEQ ID NOs: 449, 501, 544, 794, 1293, 1307, 1511, 1755, 2492, or 2575. In any of the foregoing embodiments, the modified oligonucleotide can be 10 to 30 linked nucleosides in length. In certain embodiments, the compound is ION 1062428, 1062641, 1062835, 1062937, 1063268, 1063649, 1063655, 1063734, 1064096, or 1064313. In any of the foregoing embodiments, the compound can be single-stranded or double-stranded. In any of the foregoing embodiments, the compound can be an antisense compound or oligomeric compound.

Certain embodiments are drawn to use of a compound comprising a FOXP3 specific inhibitor for the manufacture or preparation of a medicament for treating cancer. Certain embodiments are drawn to use of a compound comprising a FOXP3 specific inhibitor for the preparation of a medicament for treating cancer. In certain embodiments, the cancer is a cancer having FOXP3 positive (FOXP3+) Tregs in the microenvironment or stroma or tumor draining lymph nodes, lung cancer, non-small cell lung carcinoma (NSCLC), small-cell lung carcinoma (SCLC), squamous cell carcinoma (SCC), head and neck cancer, head and neck squamous cell carcinoma (HNSCC), gastrointestinal cancer, large intestinal cancer, small intestinal cancer, stomach cancer, colon cancer, colorectal cancer, bladder cancer, liver cancer, hepatocellular carcinoma (HCC), esophageal cancer, pancreatic cancer, biliary tract cancer, gastric cancer, urothelial cancer, breast cancer, triple-negative breast cancer (TNBC), ovarian cancer, endometrial cancer, cervical cancer, prostate cancer, mesothelioma, sarcomas (e.g. epitheloid, rhabdoid and synovial), chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the compound comprises an antisense compound targeted to FOXP3. In certain embodiments, the compound comprises an oligonucleotide targeted to FOXP3. In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 9-3246. In certain embodiments, the compound comprises a modified oligonucleotide 16 to 80 linked nucleosides in length and having a nucleobase sequence comprising the nucleobase sequence of any one of SEQ ID NOs: 9-3246. In certain embodiments, the compound comprises a modified oligonucleotide consisting of the nucleobase sequence of any one of SEQ ID NOs: 9-3246. In certain embodiments, the compound comprises a modified oligonucleotide of 16 to 80 linked nucleosides in length having a nucleobase sequence comprising any one of SEQ ID NOs: 449, 501, 544, 794, 1293, 1307, 1511, 1755, 2492, or 2575. In certain embodiments, the compound comprises a modified oligonucleotide having a nucleobase sequence consisting of any one of SEQ ID NOs: 449, 501, 544, 794, 1293, 1307, 1511, 1755, 2492, or 2575. In any of the foregoing embodiments, the modified oligonucleotide can be 10 to 30 linked nucleosides in length. In certain embodiments, the compound is ION 1062428, 1062641, 1062835, 1062937, 1063268, 1063649, 1063655, 1063734, 1064096, or 1064313. In any of the foregoing embodiments, the compound can be single-stranded or double-stranded. In any of the foregoing embodiments, the compound can be an antisense compound or oligomeric compound.

Certain embodiments are drawn to use of a compound comprising a FOXP3 specific inhibitor for the manufacture or preparation of a medicament for reducing or inhibiting immunosuppression, Treg immunosuppressive activity, cancer cell proliferation, tumor growth, or metastasis in an individual having cancer. Certain embodiments are drawn to use of a compound comprising a FOXP3 specific inhibitor for the manufacture or preparation of a medicament for inducing or activating anticancer or antitumor immunity; anticancer or antitumor immune response; immune cell activation or infiltration; inflammatory cell activation or infiltration; effector immune cell activation or infiltration; T cell activation or infiltration; CD8 T cell activation or infiltration; NK cell activation or infiltration; macrophage and dendritic cell activation or infiltration; inflammation; or inflammatory cytokine or chemokine expression in an individual having cancer.

In certain embodiments, the cancer is a cancer having FOXP3 positive (FOXP3+) Tregs in the microenvironment or stroma or tumor draining lymph nodes, lung cancer, non-small cell lung carcinoma (NSCLC), small-cell lung carcinoma (SCLC), squamous cell carcinoma (SCC), head and neck cancer, head and neck squamous cell carcinoma (HNSCC), gastrointestinal cancer, large intestinal cancer, small intestinal cancer, stomach cancer, colon cancer, colorectal cancer, bladder cancer, liver cancer, hepatocellular carcinoma (HCC), esophageal cancer, pancreatic cancer, biliary tract cancer, gastric cancer, urothelial cancer, breast cancer, triple-negative breast cancer (TNBC), ovarian cancer, endometrial cancer, cervical cancer, prostate cancer, mesothelioma, sarcomas (e.g. epitheloid, rhabdoid and synovial), chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, the compound comprises an antisense compound targeted to FOXP3. In certain embodiments, the compound comprises an oligonucleotide targeted to FOXP3.

In certain embodiments, the compound comprises a modified oligonucleotide 8 to 80 linked nucleosides in length and having a nucleobase sequence comprising at least 8 contiguous nucleobases of any of the nucleobase sequences of SEQ ID NOs: 9-3246. In certain embodiments, the compound comprises a modified oligonucleotide 16 to 80 linked nucleosides in length and having a nucleobase sequence comprising the nucleobase sequence of any one of SEQ ID NOs: 9-3246. In certain embodiments, the compound comprises a modified oligonucleotide consisting of the nucleobase sequence of any one of SEQ ID NOs: 9-3246. In certain embodiments, the compound comprises a modified oligonucleotide of 16 to 80 linked nucleosides in length having a nucleobase sequence comprising any one of SEQ ID NOs: 449, 501, 544, 794, 1293, 1307, 1511, 1755, 2492, or 2575. In certain embodiments, the compound comprises a modified oligonucleotide having a nucleobase sequence consisting of any one of SEQ ID NOs: 449, 501, 544, 794, 1293, 1307, 1511, 1755, 2492, or 2575. In any of the foregoing embodiments, the modified oligonucleotide can be 10 to 30 linked nucleosides in length. In certain embodiments, the compound is ION 1062428, 1062641, 1062835, 1062937, 1063268, 1063649, 1063655, 1063734, 1064096, or 1064313. In any of the foregoing embodiments, the compound can be single-stranded or double-stranded. In any of the foregoing embodiments, the compound can be an antisense compound or oligomeric compound.

In any of the foregoing methods or uses, the compound can be targeted to FOXP3. In certain embodiments, the compound comprises or consists of a modified oligonucleotide, for example a modified oligonucleotide 8 to 80 linked nucleosides in length, 10 to 30 linked nucleosides in length, 12 to 30 linked nucleosides in length, or 20 linked nucleosides in length. In certain embodiments, the modified oligonucleotide is at least 80%, 85%, 90%, 95% or 100% complementary to any of the nucleobase sequences recited in SEQ ID NOs: 1-5. In certain embodiments, the modified oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide comprises a gap segment consisting of linked deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing embodiments, the modified oligonucleotide can be 12 to 30, 15 to 30, 15 to 25, 15 to 24, 16 to 24, 17 to 24, 18 to 24, 19 to 24, 20 to 24, 19 to 22, 20 to 22, 16 to 20, or 17 or 20 linked nucleosides in length. In certain embodiments, the modified oligonucleotide is at least 80%, 85%, 90%, 95% or 100% complementary to any of the nucleobase sequences recited in SEQ ID NOs: 1-5. In certain embodiments, the modified oligonucleotide comprises at least one modified internucleoside linkage, at least one modified sugar and/or at least one modified nucleobase. In certain embodiments, the modified internucleoside linkage is a phosphorothioate internucleoside linkage, the modified sugar is a bicyclic sugar or a 2'-O-methoxyethyl, and the modified nucleobase is a 5-methylcytosine. In certain embodiments, the modified oligonucleotide comprises a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing methods or uses, the compound can comprise or consist of a modified oligonucleotide 16 to 80 linked nucleosides in length and having a nucleobase sequence comprising any one of SEQ ID NOs: 9-3246, wherein the modified oligonucleotide comprises:

a gap segment consisting of linked 2'-deoxynucleosides;

a 5' wing segment consisting of linked nucleosides; and a 3' wing segment consisting of linked nucleosides;

wherein the gap segment is positioned between the 5' wing segment and the 3' wing segment and wherein each nucleoside of each wing segment comprises a modified sugar. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of a modified oligonucleotide 16-80 linked nucleobases in length having a nucleobase sequence comprising the sequence recited in any one of SEQ ID NOs: 449, 501, 544, 794, 1293, 1307, 1511, 1755, 2492, or 2575, wherein the modified oligonucleotide comprises:

a gap segment consisting of linked deoxynucleosides;

a 5' wing segment consisting of linked nucleosides; and a 3' wing segment consisting of linked nucleosides;

wherein the gap segment is positioned between the 5' wing segment and the 3' wing segment and wherein each nucleoside of each wing segment comprises a modified sugar. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of a modified oligonucleotide 16-80 linked nucleobases in length having a nucleobase sequence comprising the sequence recited in any one of SEQ ID NOs: 449, 501, 544, 794, 1293, 1307, 1511, 1755, 2492, or 2575, wherein the modified oligonucleotide comprises:

a gap segment consisting often linked deoxynucleosides;

a 5' wing segment consisting of three linked nucleosides; and a 3' wing segment consisting of three linked nucleosides;

wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In certain embodiments, a compound comprises or consists of a modified oligonucleotide 16-80 linked nucleobases in length having a nucleobase sequence comprising the sequence recited in SEQ ID NO: 449, wherein the modified oligonucleotide comprises:

a gap segment consisting of ten linked deoxynucleosides;
a 5' wing segment consisting of three linked nucleosides; and
a 3' wing segment consisting of three linked nucleosides;
wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine. In certain embodiments, the modified oligonucleotide is 16-30 linked nucleosides in length. In certain embodiments, the modified oligonucleotide is 16 linked nucleosides in length.

In any of the foregoing methods or uses, the compound can comprise or consist of ION 1063734 or salt thereof, having the following chemical structure:

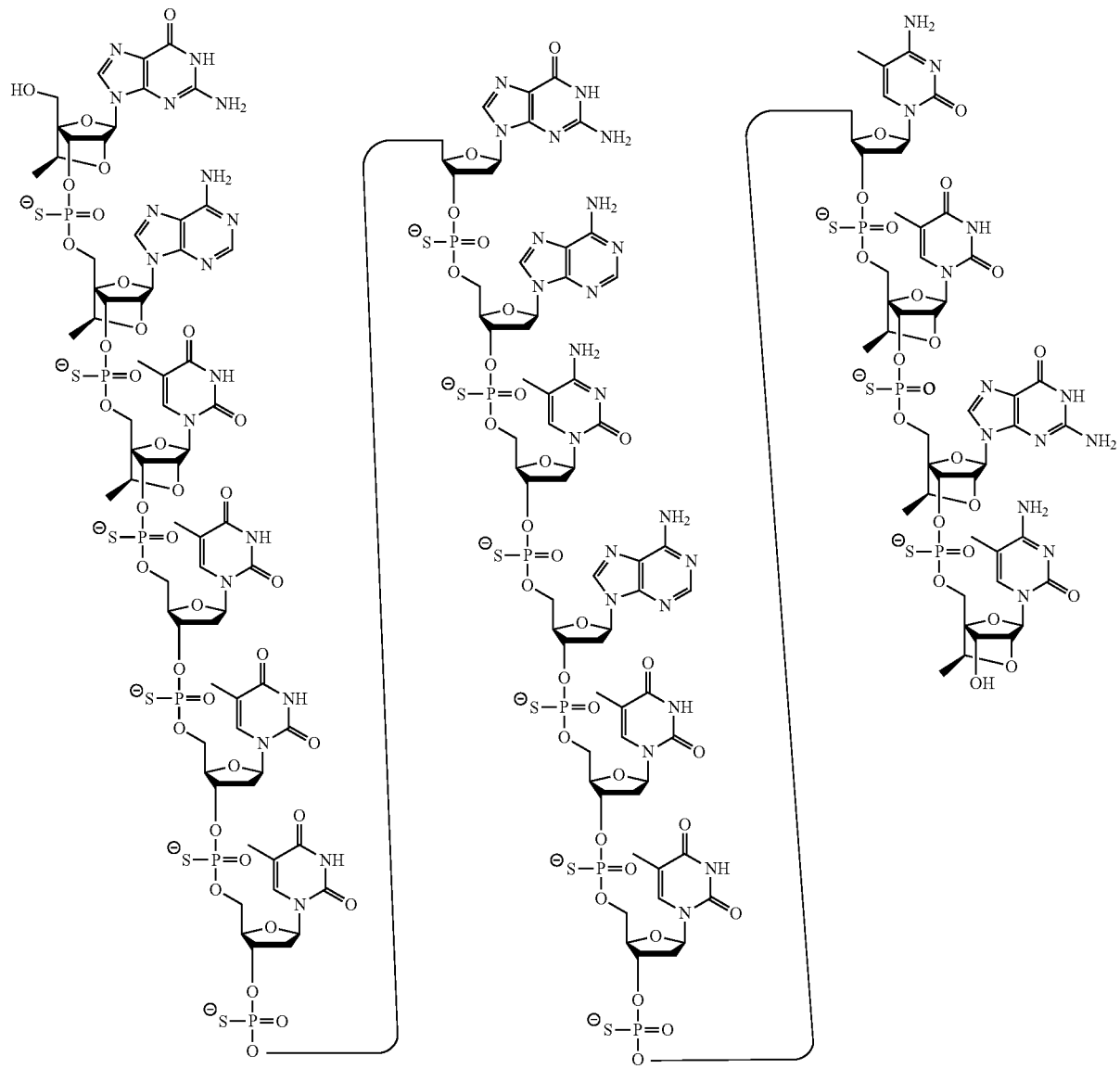

In any of the foregoing methods or uses, the compound can comprise or consist of ION 1063734, having the following chemical structure:

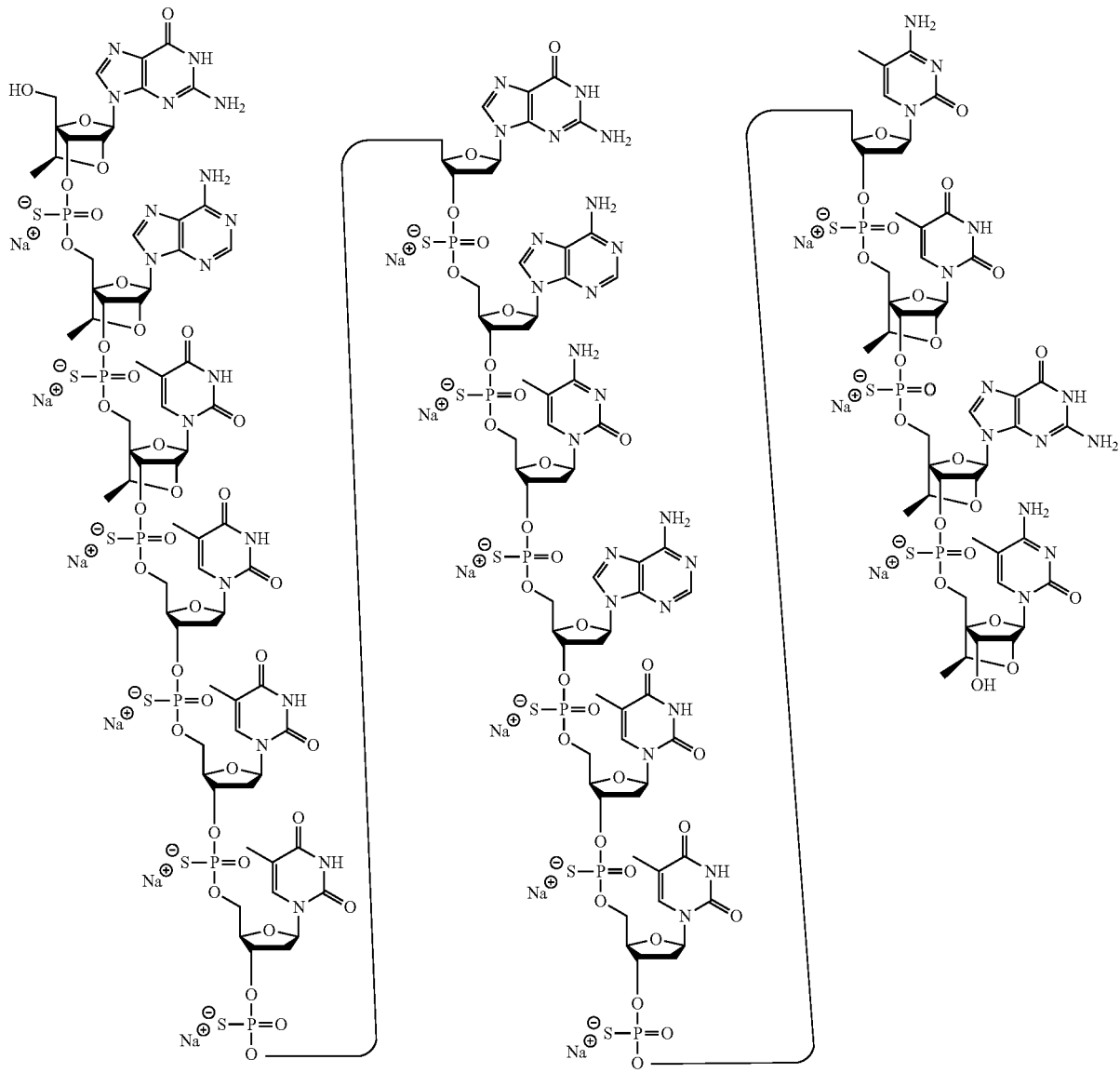

In any of the foregoing methods or uses, the compound can be administered parenterally. For example, in certain embodiments the compound can be administered through injection or infusion. Parenteral administration includes subcutaneous administration, intravenous administration, intramuscular administration, intraarterial administration, intraperitoneal administration, or intracranial administration, e.g. intrathecal or intracerebroventricular administration.

Certain Combinations and Combination Therapies

In certain embodiments, a first agent comprising a compound described herein is co-administered with one or more secondary agents. In certain embodiments, such second agents are designed to treat the same disease, disorder, or condition as the first agent described herein. In certain embodiments, such second agents are designed to treat a different disease, disorder, or condition as the first agent described herein. In certain embodiments, a first agent is designed to treat an undesired side effect of a second agent. In certain embodiments, second agents are co-administered with the first agent to treat an undesired effect of the first agent. In certain embodiments, such second agents are designed to treat an undesired side effect of one or more pharmaceutical compositions as described herein. In certain embodiments, second agents are co-administered with the first agent to produce a combinational effect. In certain embodiments, second agents are co-administered with the first agent to produce a synergistic effect. In certain embodiments, the co-administration of the first and second agents permits use of lower dosages than would be required to achieve a therapeutic or prophylactic effect if the agents were administered as independent therapy.

In certain embodiments, one or more compounds or compositions provided herein are co-administered with one or more secondary agents. In certain embodiments, one or more compounds or compositions provided herein and one or more secondary agents, are administered at different times. In certain embodiments, one or more compounds or compositions provided herein and one or more secondary agents, are prepared together in a single formulation. In certain embodiments, one or more compounds or compositions provided herein and one or more secondary agents, are prepared separately.

In certain embodiments, a secondary agent is selected from: innate immune cell activators including but not limited to TLR agonists (e.g. MEDI9197) and STING agonists (e.g. MK-1454); inhibitors of immunoinhibitory mediators including but not limited to CD39 and CD73 inhibitors (e.g. oleclumab), IDO1 inhibitors (e.g. epacadostat), and arginase inhibitors (e.g. INCB001158); activators of T cell costimulatory receptors including but not limited to CD137 agonists (e.g. urelumab, utomilumab), CD27 agonists (e.g. varlimumab), and CD40 agonists (e.g. MEDI5083); inhibitors of T cell inhibitory receptors including but not limited to LAG3 inhibitors (e.g. relatlimab), TIM3 inhibitors (e.g. LY3321367), and TIGIT inhibitors (e.g. tiragolumab); activators of Treg inhibitory receptors including but not limited to GITR agonists (e.g. MEDI1873); NK cell activation strategies including but not limited to NKG2a (e.g. monalizumab); cancer vaccines (e.g. Sipuleucel-T); and immunogenic killing of the tumor including but not limited to oncolytic viruses, radiation, photodynamic therapy, and chemotherapy (e.g. anthracyclines, oxaliplatin etc).

In certain embodiments, a secondary agent is selected from: immuno-oncology (IO) agents; immune checkpoint inhibitors; immunomodulatory agents; PDI-PDL1/2 pathway inhibitors; PD-L1 inhibitors including but not limited to durvalumab, avelumab, and atezolizumab; PD-1 inhibitors including but not limited to nivolumab and pembrolizumab; CTLA-4 inhibitors including but not limited to ipilimumab and tremelimumab; STAT3 inhibitors including but not limited to STAT3 siRNA, STAT3 antisense oligonucleotides, and danvatirsen (AZD9150); and adenosine 2A receptor (A2AR) antagonists including but not limited to AZD4635.

Certain embodiments are directed to the use of a compound targeted to FOXP3 as described herein in combination with a secondary agent. In particular embodiments such use is in a method of treating a patient suffering from cancer including, but not limited to, a cancer having FOXP3 positive (FOXP3+) Tregs in the microenvironment or stroma or tumor draining lymph nodes, lung cancer, non-small cell lung carcinoma (NSCLC), small-cell lung carcinoma (SCLC), squamous cell carcinoma (SCC), head and neck cancer, head and neck squamous cell carcinoma (HNSCC), gastrointestinal cancer, large intestinal cancer, small intestinal cancer, stomach cancer, colon cancer, colorectal cancer, bladder cancer, liver cancer, hepatocellular carcinoma (HCC), esophageal cancer, pancreatic cancer, biliary tract cancer, gastric cancer, urothelial cancer, breast cancer, triple-negative breast cancer (TNBC), ovarian cancer, endometrial cancer, cervical cancer, prostate cancer, mesothelioma, sarcomas (e.g. epitheloid, rhabdoid and synovial), chordoma, renal cancer, renal cell carcinoma (RCC), brain cancer, neuroblastoma, glioblastoma, skin cancer, melanoma, basal cell carcinoma, merkel cell carcinoma, blood cancer, hematopoetic cancer, myeloma, multiple myeloma (MM), B cell malignancies, lymphoma, B cell lymphoma, Hodgkin lymphoma, T cell lymphoma, leukemia, or acute lymphocytic leukemia (ALL). In certain embodiments, a secondary agent is selected from: immuno-oncology (IO) agents; immune checkpoint inhibitors; immunomodulatory agents; PDI-PDL1/2 pathway inhibitors; PD-L1 inhibitors including but not limited to durvalumab, avelumab, and atezolizumab; PD-1 inhibitors including but not limited to nivolumab and pembrolizumab; CTLA-4 inhibitors including but not limited to ipilimumab and tremelimumab; STAT3 inhibitors including but not limited to STAT3 siRNA, STAT3 antisense oligonucleotides, and danvatirsen (AZD9150).

Certain embodiments are drawn to a combination of a compound targeted to FOXP3 as described herein and a secondary agent, such as a secondary agent selected from: immuno-oncology (IO) agents; immune checkpoint inhibitors; immunomodulatory agents; PDI-PDL1/2 pathway inhibitors; PD-L1 inhibitors including but not limited to durvalumab, avelumab, and atezolizumab; PD-1 inhibitors including but not limited to nivolumab and pembrolizumab; CTLA-4 inhibitors including but not limited to ipilimumab and tremelimumab; STAT3 inhibitors including but not limited to STAT3 siRNA, STAT3 antisense oligonucleotides, and danvatirsen (AZD9150).

In certain embodiments the compound targeted to FOXP3 as described herein and the secondary agent are used in combination treatment by administering the two agents simultaneously, separately or sequentially. In certain embodiments the two agents are formulated as a fixed dose combination product. In other embodiments the two agents are provided to the patient as separate units which can then either be taken simultaneously or serially (sequentially).

In certain embodiments, a compound targeted to FOXP3 as described herein is used in combination with an immunomodulatory agent such as an anti-PD-L1 antibody (or an antigen-binding fragment thereof), an anti-PD-1 antibody (or an antigen-binding fragment thereof), an anti-CTLA-4 antibody (or an antigen-binding fragment thereof) or an OX40 agonist ((e.g., an OX40 ligand fusion protein, or an OX40 agonist antibody or antigen-binding fragment thereof).

In certain embodiments, a compound targeted to FOXP3 as described herein is used in combination with an immune checkpoint inhibitor such as an anti-PD-L1 antibody (or an antigen-binding fragment thereof), an anti-PD-1 antibody (or an antigen-binding fragment thereof), or an anti-CTLA-4 antibody (or an antigen-binding fragment thereof).

Anti-PD-L1 antibodies are known in the art. Exemplary anti-PD-L1 antibodies include: MEDI4736 (durvalumab), MPDL3280A, BMS936559, 2.7A4, AMP-714, MDX-1105 and MPDL3280A (atezolizumab).

Anti-PD-1 antibodies are known in the art. Exemplary anti-PD-1 antibodies include: nivolumab, pembrolizumab, pidilizumab, and AMP-514

Anti-CTLA-4 antibodies are known in the art. Exemplary anti-CTLA-4 antibodies include: tremelimumab and ipilimumab, also termed MDX-010 (or BMS-734016).

OX40 agonists and antibodies are known in the art. Exemplary OX40 agonists and/or antibodies include: MEDI6383, 9B12 and MEDI0562.

In one embodiment, the combination includes the antisense oligonucleotide Ionis 651987 or a salt thereof, and at least one immunomodulator selected from the group consisting of: MEDI4736, MPDL3280A, BMS936559, 2.7A4, AMP-714, MDX-1105, nivolumab, pembrolizumab, pidilizumab, MPDL3280A, tremelimumab, ipilimumab, MEDI0562 and MEDI0562.

In one embodiment, the combination includes the anti-PD-L1 antibody MEDI4736 (duvalumab) and ION 1063734.

In one embodiment, the combination includes ION 1063734, the anti-PD-L1 antibody MEDI4736 (durvalumab) and the anti-CTLA-4 antibody tremelimumab.

Certain Anti-PD-L1 Antibodies

Antibodies that specifically bind and inhibit PD-L1 are included in the present disclosure.

Durvalumab (MEDI4736) is an exemplary anti-PD-L1 antibody that is selective for a PD-L1 polypeptide and blocks the binding of PD-L1 to the PD-1 and CD80 receptors. Durvalumab can relieve PD-L 1-mediated suppression of human T-cell activation in vitro and inhibits tumor growth in a xenograft model via a T-cell dependent mechanism.

Information regarding durvalumab (or fragments thereof) for use in the methods provided herein can be found in U.S. Pat. No. 8,779,108, the disclosure of which is incorporated herein by reference in its entirety. The fragment crystallizable (Fc) domain of durvalumab contains a triple mutation in the constant domain of the IgG1 heavy chain that reduces binding to the complement component C1q and the Fcγ receptors responsible for mediating antibody-dependent cell-mediated cytotoxicity (ADCC). In certain embodiments, MEDI4736 or an antigen-binding fragment thereof for use in the methods provided herein comprises the variable heavy chain and variable light chain CDR sequences of the 2.14H9OPT antibody as disclosed in U.S. Pat. Nos. 8,779,108 and 9,493,565, which is herein incorporated by reference in its entirety.

There are numerous anti-PD-L1 antibodies in the published literature that could feature in the present disclosure, including compounds in development and/or in clinical trials such as: durvalumab (MEDI4736), MPDL3280A, BMS936559, 2.7A4, AMP-714 and MDX-1105. Patent specifications disclosing anti-PD-L1 antibodies that may be useful in the present disclosure include: U.S. Pat. Nos. 7,943,743; 8,383,796; 9,102,725; 9,273,135 (BMS/Medarex), US2006/0153841 (Dana Farber), US2011/0271358 (Dana Farber), U.S. Pat. Nos. 8,552,154 and 9,102,727 (Dana Farber), U.S. Pat. No. 8,217,149 (Genentech), including issued U.S. Pat. No. 8,217,149, US2012/0039906 (INSERM), US2016/0031990 (Amplimmune), U.S. Pat. No. 8,779,108 (MedImmune—for durvalumab/MEDI4726 and 2.7A4), US2014/0044738 (Amplimmune—for AMP-714) and US2010/0285039 (John's Hopkins University). Each of these disclosures is herein incorporated by reference in its entirety.

Certain Anti-CTLA-4 Antibodies

Antibodies that specifically bind CTLA-4 and inhibit CTLA-4 activity are useful for enhancing an anti-tumor immune response. Information regarding tremelimumab (or antigen-binding fragments thereof) for use in the methods provided herein can be found in U.S. Pat. No. 6,682,736 (where it is referred to as 11.2.1), the disclosure of which is incorporated herein by reference in its entirety. Tremelimumab (also known as CP-675,206, CP-675, CP-675206, and ticilimumab) is a human IgG2 monoclonal antibody that is highly selective for CTLA-4 and blocks binding of CTLA-4 to CD80 (B7.1) and CD86 (B7.2). It has been shown to result in immune activation in vitro and some patients treated with tremelimumab have shown tumor regression. In certain embodiments, tremelimumab or an antigen-binding fragment thereof for use in the methods provided herein comprises the variable heavy chain and variable light chain CDR sequences of the 11.2.1 antibody as disclosed in U.S. Pat. No. 6,682,736, which is herein incorporated by reference in its entirety.

Other anti-CTLA-4 antibodies are described, for example, in US 20070243184. In one embodiment, the anti-CTLA-4 antibody is Ipilimumab, also termed MDX-010; BMS-734016.

Certain OX40 Agonists

OX40 agonists interact with the OX40 receptor on CD4+ T-cells during, or shortly after, priming by an antigen resulting in an increased response of the CD4+ T-cells to the antigen. An OX40 agonist interacting with the OX40 receptor on antigen specific CD4+ T-cells can increase T cell proliferation as compared to the response to antigen alone. The elevated response to the antigen can be maintained for a period of time substantially longer than in the absence of an OX40 agonist. Thus, stimulation via an OX40 agonist enhances the antigen specific immune response by boosting T-cell recognition of antigens, e.g., tumor cells. OX40 agonists are described, for example, in U.S. Pat. Nos. 6,312,700, 7,504,101, 7,622,444, and 7,959,925, which are incorporated herein by reference in their entireties. Methods of using such agonists in cancer treatment are described, for example, in US2015/0098942 and in US2015/0157710, each of which are incorporated herein by reference in its entirety.

OX40 agonists include, but are not limited to OX40 binding molecules, e.g., binding polypeptides, e.g., OX40 ligand ("OX40L") or an OX40-binding fragment, variant, or derivative thereof, such as soluble extracellular ligand domains and OX40L fusion proteins, and anti-OX40 antibodies (for example, monoclonal antibodies such as humanized monoclonal antibodies), or an antigen-binding fragment, variant or derivative thereof. Examples of anti-OX40 monoclonal antibodies are described, for example, in U.S. Pat. Nos. 5,821,332 and 6,156,878, the disclosures of which are incorporated herein by reference in their entireties. In certain embodiments, the anti-OX40 monoclonal antibody is 9B 12, or an antigen-binding fragment, variant, or derivative thereof, as described in Weinberg, A. D., et al. J Immunother 29, 575-585 (2006), which is incorporated herein by reference in its entirety. In another embodiment, an OX40 antibody is MEDI0562 as described in US 2016/0137740.

In other embodiments, the antibody which specifically binds to OX40, or an antigen-binding fragment thereof binds to the same OX40 epitope as mAb 9B12. An exemplary humanized OX40 antibody is described by Morris et al., Mol Immunol. May 2007; 44(12): 3112-3121. 9B12 is a murine IgG, anti-OX40 mAb directed against the extracellular domain of human OX40 (CD 134) (Weinberg, A. D., et al. J Immunother 29, 575-585 (2006)). It was selected from a panel of anti-OX40 monoclonal antibodies because of its ability to elicit an agonist response for OX40 signaling, stability, and for its high level of production by the hybridoma. For use in clinical applications, 9B12 mAb is equilibrated with phosphate buffered saline, pH 7.0, and its concentration is adjusted to 5.0 mg/ml by diafiltration.

"OX40 ligand" ("OX40L") (also variously termed tumor necrosis factor ligand superfamily member 4, gp34, TAX transcriptionally-activated glycoprotein-1, and CD252) is found largely on antigen presenting cells (APCs), and can be induced on activated B cells, dendritic cells (DCs), Langerhans cells, plamacytoid DCs, and macrophages (Croft, M., (2010) *Ann Rev Immunol* 28:57-78). Other cells, including activated T cells, NK cells, mast cells, endothelial cells, and smooth muscle cells can express OX40L in response to inflammatory cytokines (Id.). OX40L specifically binds to the OX40 receptor. The human protein is described in U.S. Pat. No. 6,156,878. The mouse OX40L is described in U.S. Pat. No. 5,457,035. OX40L is expressed on the surface of cells and includes an intracellular, a transmembrane and an extracellular receptor-binding domain. A functionally active soluble form of OX40L can be produced by deleting the intracellular and transmembrane domains as described, e.g., in U.S. Pat. Nos. 5,457,035; 6,312,700; 6,156,878; 6,242,566; 6,528,055; 6,528,623; 7,098,184; and 7,125,670, the disclosures of which are incorporated herein for all purposes. A functionally active form of OX40L is a form that retains the capacity to bind specifically to OX40, that is, that possesses an OX40 "receptor binding domain." An example is amino acids 51 to 183 of human OX40L. Methods of determining the ability of an OX40L molecule or derivative to bind specifically to OX40 are discussed below. Methods of making and using OX40L and its derivatives (such as derivatives that include an OX40 binding domain) are described in U.S. Pat. Nos. 6,156,878; 6,242,566; 6,528,055; 6,528,623; 7,098,184; and 7,125,670, which also describe proteins comprising the soluble form of OX40L linked to other peptides, such as human immunoglobulin ("Ig") Fc regions, that can be produced to facilitate purification of OX40 ligand from cultured cells, or to enhance the stability of the molecule after in vivo administration to a mammal (see also, U.S. Pat. Nos. 5,457,035 and 7,959,925, both of which are incorporated by reference herein in their entireties).

Also included within the definition of OX40L are OX40 ligand variants which vary in amino acid sequence from naturally occurring OX40 ligand molecules but which retain the ability to specifically bind to an OX40 receptor. Such variants are described in U.S. Pat. Nos. 5,457,035; 6,156,878; 6,242,566; 6,528,055; 6,528,623; 7,098,184; and 7,125,670. In a related embodiment, a mutant of OX40L which has lost the ability to specifically bind to OX40, for example amino acids 51 to 183, in which the phenylalanine at position 180 of the receptor-binding domain of human OX40L has been replaced with alanine (F180A) is used.

OX40 agonists include a fusion protein in which one or more domains of OX40L is covalently linked to one or more additional protein domains. Exemplary OX40L fusion proteins that can be used as OX40 agonists are described in U.S. Pat. No. 6,312,700, the disclosure of which is incorporated herein by reference in its entirety. In one embodiment, an OX40 agonist includes an OX40L fusion polypeptide that self-assembles into a multimeric (e.g., trimeric or hexameric) OX40L fusion protein. Such fusion proteins are described, e.g., in U.S. Pat. No. 7,959,925, which is incorporated by reference herein in its entirety. The multimeric OX40L fusion protein exhibits increased efficacy in enhancing antigen specific immune response in a subject, particularly a human subject, due to its ability to spontaneously assemble into highly stable trimers and hexamers.

In another embodiment, an OX40 agonist capable of assembling into a multimeric form includes a fusion polypeptide comprising in an N-terminal to C-terminal direction: an immunoglobulin domain, wherein the immunoglobulin domain includes an Fc domain, a trimerization domain, wherein the trimerization domain includes a coiled coil trimerization domain, and a receptor binding domain, wherein the receptor binding domain is an OX40 receptor binding domain, e.g., an OX40L or an OX40-binding fragment, variant, or derivative thereof, where the fusion polypeptide can self-assemble into a trimeric fusion protein. In one aspect, an OX40 agonist capable of assembling into a multimeric form is capable of binding to the OX40 receptor and stimulating at least one OX40 mediated activity. In certain aspects, the OX40 agonist includes an extracellular domain of OX40 ligand.

The trimerization domain of an OX40 agonist capable of assembling into a multimeric form serves to promote self-assembly of individual OX40L fusion polypeptide molecules into a trimeric protein. Thus, an OX40L fusion polypeptide with a trimerization domain self-assembles into a trimeric OX40L fusion protein. In one aspect, the trimerization domain is an isoleucine zipper domain or other coiled coli polypeptide structure. Exemplary coiled coil trimerization domains include: TRAF2 (GENBANK® Accession No. Q12933, amino acids 299-348; Thrombospondin 1 (Accession No. P07996, amino acids 291-314; Matrilin-4 (Accession No. O95460, amino acids 594-618; CMP (matrilin-1) (Accession No. NP-002370, amino acids 463-496; HSF1 (Accession No. AAX42211, amino acids 165-191; and Cubilin (Accession No. NP-001072, amino acids 104-138. In certain specific aspects, the trimerization domain includes a TRAF2 trimerization domain, a Matrilin-4 trimerization domain, or a combination thereof.

OX40L FP is a human OX40 ligand IgG4P fusion protein that specifically binds to, and triggers signaling by, the human OX40 receptor, a member of the TNFR superfamily. OX40L FP is also disclosed in US2016/0024176, incorporated herein by reference in its entirety. OX40L FP is composed of three distinct domains: (1) human OX40 ligand extracellular receptor binding domains (RBDs) that form homotrimers and bind the OX40 receptor; (2) isoleucine zipper trimerization domains derived from TNFR-associated factor 2 that stabilize the homotrimeric structure of the OX40 ligand RBDs; and (3) human IgG4 fragment crystallizable gamma (Fcγ) domains that facilitate Fcγ receptor clustering of the fusion protein when bound to OX40 receptors, and contain a serine to proline substitution at position 228 (according to EU numbering) in the hinge regions (IgG4P) to promote stability of two sets of OX40 ligand RBD homotrimers. The IgG4P Fc domain is fused directly to an isoleucine zipper trimerization domain derived from amino acid residues 310-349 of human tumor necrosis factor 2 (TRAF2). Fused to the c-terminus of the TRAF2 domain are amino acid residues 51-183 of the extracellular receptor binding domain (RBD) of human OX40L (gene name TNFSF4). The TRAF2 domain stabilizes the homotrimeric structure of OX40L RBDs to enable OX40 binding and activation, while the IgG4P Fc domain confers serum stability, dimerization of OX40L trimers, and facilitates Fcγ receptor clustering of the hexameric fusion protein. One OX40L FP variant possesses a phenylalanine (F) to alanine (A) mutation at the amino acid corresponding to position 180 in OX40L. Another OX40L FP variant has the IgG4P Fc domain replaced with a human IgG1 Fc domain. In particular embodiments, the OX40 agonist for use in the present disclosure is one of the OX40L FP variants.

In particular embodiments, the OX40 agonist for use in the present disclosure has been modified to increase its serum half-life. For example, the serum half-life of an OX40 agonist can be increased by conjugation to a heterologous molecule such as serum albumin, an antibody Fc region, or PEG. In certain embodiments, OX40 agonists can be conjugated to other therapeutic agents or toxins to form immunoconjugates and/or fusion proteins. In certain embodiments, the OX40 agonist can be formulated so as to facilitate administration and promote stability of the active agent.

Antibody Derivatives

Antibodies for use in the present disclosure (e.g., anti-CTLA-4, anti-PD-L1, anti-PD-1, anti-OX40) may include variants of these sequences that retain the ability to specifically bind their targets. Such variants may be derived from the sequence of these antibodies by a skilled artisan using techniques well known in the art. For example, amino acid substitutions, deletions, or additions, can be made in the FRs and/or in the CDRs. While changes in the FRs are usually designed to improve stability and immunogenicity of the antibody, changes in the CDRs are typically designed to increase affinity of the antibody for its target. Variants of FRs also include naturally occurring immunoglobulin allotypes. Such affinity-increasing changes may be determined empirically by routine techniques that involve altering the CDR and testing the affinity antibody for its target. For example, conservative amino acid substitutions can be made within any one of the disclosed CDRs. Various alterations can be made according to the methods described in Antibody Engineering, 2nd ed., Oxford University Press, ed. Borrebaeck, 1995. These include but are not limited to nucleotide sequences that are altered by the substitution of different codons that encode a functionally equivalent amino acid residue within the sequence, thus producing a "silent" change. For example, the nonpolar amino acids include alanine, leucine, isoleucine, valine, proline, phenylalanine, tryptophan, and methionine. The polar neutral amino acids include glycine, serine, threonine, cysteine, tyrosine, asparagine, and glutamine. The positively charged (basic) amino acids include arginine, lysine, and histidine. The negatively charged (acidic) amino acids include aspartic acid and glutamic acid.

Derivatives and analogs of antibodies of the present disclosure can be produced by various techniques well known in the art, including recombinant and synthetic methods (Maniatis (1990) Molecular Cloning, A Laboratory Manual, 2nd ed., Cold Spring Harbor Laboratory, Cold Spring Harbor, N.Y., and Bodansky et al. (1995) The Practice of Peptide Synthesis, 2nd ed., Spring Verlag, Berlin, Germany). Analogous shuffling or combinatorial techniques are also disclosed by Stemmer (Nature (1994) 370: 389-391), who describes the technique in relation to a β-lactamase gene but observes that the approach may be used for the generation of antibodies.

One may generate novel VH or VL regions carrying one or more sequences derived from the sequences disclosed herein using random mutagenesis of one or more selected VH and/or VL genes. One such technique, error-prone PCR, is described by Gram et al. (Proc. Nat. Acad. Sci. U.S.A. (1992) 89: 3576-3580). Another method that may be used is to direct mutagenesis to CDRs of VH or VL genes. Such techniques are disclosed by Barbas et al. (Proc. Nat. Acad. Sci. U.S.A. (1994) 91: 3809-3813) and Schier et al. (J. Mol. Biol. (1996) 263: 551-567).

Similarly, one or more, or all three CDRs may be grafted into a repertoire of VH or VL domains, which are then screened for an antigen-binding fragment specific for CTLA-4 or PD-L 1.

A portion of an immunoglobulin variable domain will comprise at least one of the CDRs substantially as set out herein and, optionally, intervening framework regions from the scFv fragments as set out herein. The portion may include at least about 50% of either or both of FR1 and FR4, the 50% being the C-terminal 50% of FR1 and the N-terminal 50% of FR4. Additional residues at the N-terminal or C-terminal end of the substantial part of the variable domain may be those not normally associated with naturally occurring variable domain regions. For example, construction of antibodies by recombinant DNA techniques may result in the introduction of N- or C-terminal residues encoded by linkers introduced to facilitate cloning or other manipulation steps. Other manipulation steps include the introduction of linkers to join variable domains to further protein sequences including immunoglobulin heavy chain constant regions, other variable domains (for example, in the production of diabodies), or proteinaceous labels as discussed in further detail below.

A skilled artisan will recognize that antibodies for use in the present disclosure may comprise antigen-binding fragments containing only a single CDR from either VL or VH domain. Either one of the single chain specific binding domains can be used to screen for complementary domains capable of forming a two-domain specific antigen-binding fragment capable of, for example, binding to CTLA-4 and PD-L 1.

Antibodies for use in the present disclosure described herein can be linked to another functional molecule, e.g., another peptide or protein (albumin, another antibody, etc.). For example, the antibodies can be linked by chemical cross-linking or by recombinant methods. The antibodies may also be linked to one of a variety of nonproteinaceous polymers, e.g., polyethylene glycol, polypropylene glycol, or polyoxyalkylenes, in the manner set forth in U.S. Pat. Nos. 4,640,835; 4,496,689; 4,301,144; 4,670,417; 4,791,192; or 4,179,337. The antibodies can be chemically modified by covalent conjugation to a polymer, for example, to increase their circulating half-life. Exemplary polymers and methods to attach them are also shown in U.S. Pat. Nos. 4,766,106; 4,179,337; 4,495,285, and 4,609,546.

The antibodies may also be altered to have a glycosylation pattern that differs from the native pattern. For example, one or more carbohydrate moieties can be deleted and/or one or more glycosylation sites added to the original antibody. Addition of glycosylation sites to the presently disclosed antibodies may be accomplished by altering the amino acid sequence to contain glycosylation site consensus sequences known in the art. Another means of increasing the number of carbohydrate moieties on the antibodies is by chemical or enzymatic coupling of glycosides to the amino acid residues of the antibody. Such methods are described in WO 87/05330, and in Aplin et al. (1981) CRC Crit. Rev. Biochem., 22: 259-306. Removal of any carbohydrate moieties from the antibodies may be accomplished chemically or enzymatically, for example, as described by Hakimuddin et al. (1987) Arch. Biochem. Biophys., 259: 52; and Edge et al. (1981) Anal. Biochem., 118: 131 and by Thotakura et al. (1987) Meth. Enzymol., 138: 350. The antibodies may also be tagged with a detectable, or functional, label. Detectable labels include radiolabels such as 131I or 99Tc, which may also be attached to antibodies using conventional chemistry. Detectable labels also include enzyme labels such as horseradish peroxidase or alkaline phosphatase. Detectable labels further include chemical moieties such as biotin, which may be detected via binding to a specific cognate detectable moiety, e.g., labeled avidin.

Antibodies, in which CDR sequences differ only insubstantially from those set forth herein are encompassed within the scope of this present disclosure. Typically, an amino acid is substituted by a related amino acid having similar charge, hydrophobic, or stereochemical characteristics. Such substitutions would be within the ordinary skills of an artisan. Unlike in CDRs, more substantial changes can be made in FRs without adversely affecting the binding properties of an antibody. Changes to FRs include, but are not limited to, humanizing a non-human derived or engineering certain framework residues that are important for antigen contact or for stabilizing the binding site, e.g., changing the class or subclass of the constant region, changing specific amino acid residues which might alter the effector function such as Fc receptor binding, e.g., as described in U.S. Pat. Nos.

5,624,821 and 5,648,260 and Lund et al. (1991) J. Immun. 147: 2657-2662 and Morgan et al. (1995) Immunology 86: 319-324, or changing the species from which the constant region is derived.

One of skill in the art will appreciate that the modifications described above are not all-exhaustive, and that many other modifications would be obvious to a skilled artisan in light of the teachings of the present disclosure.

Certain Compounds

In certain embodiments, compounds described herein can be antisense compounds. In certain embodiments, the antisense compound comprises or consists of an oligomeric compound. In certain embodiments, the oligomeric compound comprises a modified oligonucleotide. In certain embodiments, the modified oligonucleotide has a nucleobase sequence complementary to that of a target nucleic acid.

In certain embodiments, a compound described herein comprises or consists of a modified oligonucleotide. In certain embodiments, the modified oligonucleotide has a nucleobase sequence complementary to that of a target nucleic acid.

In certain embodiments, a compound or antisense compound is single-stranded. Such a single-stranded compound or antisense compound comprises or consists of an oligomeric compound. In certain embodiments, such an oligomeric compound comprises or consists of an oligonucleotide and optionally a conjugate group. In certain embodiments, the oligonucleotide is an antisense oligonucleotide. In certain embodiments, the oligonucleotide is modified. In certain embodiments, the oligonucleotide of a single-stranded antisense compound or oligomeric compound comprises a self-complementary nucleobase sequence.

In certain embodiments, compounds are double-stranded. Such double-stranded compounds comprise a first modified oligonucleotide having a region complementary to a target nucleic acid and a second modified oligonucleotide having a region complementary to the first modified oligonucleotide. In certain embodiments, the modified oligonucleotide is an RNA oligonucleotide. In such embodiments, the thymine nucleobase in the modified oligonucleotide is replaced by a uracil nucleobase. In certain embodiments, compound comprises a conjugate group. In certain embodiments, one of the modified oligonucleotides is conjugated. In certain embodiments, both the modified oligonucleotides are conjugated. In certain embodiments, the first modified oligonucleotide is conjugated. In certain embodiments, the second modified oligonucleotide is conjugated. In certain embodiments, the first modified oligonucleotide is 12-30 linked nucleosides in length and the second modified oligonucleotide is 12-30 linked nucleosides in length. In certain embodiments, one of the modified oligonucleotides has a nucleobase sequence comprising at least 8 contiguous nucleobases of any of SEQ ID NOs: 9-3246.

In certain embodiments, antisense compounds are double-stranded. Such double-stranded antisense compounds comprise a first oligomeric compound having a region complementary to a target nucleic acid and a second oligomeric compound having a region complementary to the first oligomeric compound. The first oligomeric compound of such double stranded antisense compounds typically comprises or consists of a modified oligonucleotide and optionally a conjugate group. The oligonucleotide of the second oligomeric compound of such double-stranded antisense compound may be modified or unmodified. Either or both oligomeric compounds of a double-stranded antisense compound may comprise a conjugate group. The oligomeric compounds of double-stranded antisense compounds may include non-complementary overhanging nucleosides.

Examples of single-stranded and double-stranded compounds include but are not limited to oligonucleotides, siRNAs, microRNA targeting oligonucleotides, and single-stranded RNAi compounds, such as small hairpin RNAs (shRNAs), single-stranded siRNAs (ssRNAs), and microRNA mimics.

In certain embodiments, a compound described herein has a nucleobase sequence that, when written in the 5' to 3' direction, comprises the reverse complement of the target segment of a target nucleic acid to which it is targeted.

In certain embodiments, a compound described herein comprises an oligonucleotide 10 to 30 linked subunits in length. In certain embodiments, a compound described herein comprises an oligonucleotide 12 to 30 linked subunits in length. In certain embodiments, a compound described herein comprises an oligonucleotide 12 to 22 linked subunits in length. In certain embodiments, compound described herein comprises an oligonucleotide 14 to 30 linked subunits in length. In certain embodiments, compound described herein comprises an oligonucleotide 14 to 20 linked subunits in length. In certain embodiments, a compound described herein comprises an oligonucleotide 15 to 30 linked subunits in length. In certain embodiments, a compound described herein comprises an oligonucleotide 15 to 20 linked subunits in length. In certain embodiments, a compound described herein comprises an oligonucleotide 16 to 30 linked subunits in length.

In certain embodiments, a compound described herein comprises an oligonucleotide 16 to 20 linked subunits in length. In certain embodiments, a compound described herein comprises an oligonucleotide 17 to 30 linked subunits in length. In certain embodiments, a compound described herein comprises an oligonucleotide 17 to 20 linked subunits in length. In certain embodiments, a compound described herein comprises an oligonucleotide 18 to 30 linked subunits in length. In certain embodiments, a compound described herein comprises an oligonucleotide 18 to 21 linked subunits in length. In certain embodiments, a compound described herein comprises an oligonucleotide 18 to 20 linked subunits in length. In certain embodiments, a compound described herein comprises an oligonucleotide 20 to 30 linked subunits in length. In other words, such oligonucleotides are 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits in length, respectively.

In certain embodiments, a compound described herein comprises an oligonucleotide 14 linked subunits in length. In certain embodiments, a compound described herein comprises an oligonucleotide 16 linked subunits in length.

In certain embodiments, a compound described herein comprises an oligonucleotide 17 linked subunits in length. In certain embodiments, compound described herein comprises an oligonucleotide 18 linked subunits in length. In certain embodiments, a compound described herein comprises an oligonucleotide 19 linked subunits in length. In certain embodiments, a compound described herein comprises an oligonucleotide 20 linked subunits in length. In other embodiments, a compound described herein comprises an oligonucleotide 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the compound described herein comprises an oligonucleotide 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In some embodiments the linked subunits are nucleotides, nucleosides, or nucleobases.

In certain embodiments, the compound may further comprise additional features or elements, such as a conjugate group, that are attached to the oligonucleotide. In certain embodiments, such compounds are antisense compounds. In certain embodiments, such compounds are oligomeric compounds. In embodiments where a conjugate group comprises a nucleoside (i.e. a nucleoside that links the conjugate group to the oligonucleotide), the nucleoside of the conjugate group is not counted in the length of the oligonucleotide.

In certain embodiments, compounds may be shortened or truncated. For example, a single subunit may be deleted from the 5' end (5' truncation), or alternatively from the 3' end (3' truncation). A shortened or truncated compound targeted to an FOXP3 nucleic acid may have two subunits deleted from the 5' end, or alternatively may have two subunits deleted from the 3' end, of the compound. Alternatively, the deleted nucleosides may be dispersed throughout the compound.

When a single additional subunit is present in a lengthened compound, the additional subunit may be located at the 5' or 3' end of the compound. When two or more additional subunits are present, the added subunits may be adjacent to each other, for example, in a compound having two subunits added to the 5' end (5' addition), or alternatively to the 3' end (3' addition), of the compound. Alternatively, the added subunits may be dispersed throughout the compound.

It is possible to increase or decrease the length of a compound, such as an oligonucleotide, and/or introduce mismatch bases without eliminating activity (Woolf et al. *Proc. Natl. Acad. Sci. USA* 1992, 89:7305-7309; Gautschi et al. *J. Natl. Cancer Inst.* March 2001, 93:463-471; Maher and Dolnick *Nuc. Acid. Res.* 1998, 16:3341-3358). However, seemingly small changes in oligonucleotide sequence, chemistry and motif can make large differences in one or more of the many properties required for clinical development (Seth et al. *J. Med. Chem.* 2009, 52, 10; Egli et al. *J. Am. Chem. Soc.* 2011, 133, 16642).

In certain embodiments, compounds described herein are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term "RNAi" is meant to be equivalent to other terms used to describe sequence specific RNA interference, such as post transcriptional gene silencing, translational inhibition, or epigenetics.

In certain embodiments, a compound described herein can comprise any of the oligonucleotide sequences targeted to FOXP3 described herein. In certain embodiments, the compound can be double-stranded. In certain embodiments, the compound comprises a first strand comprising at least an 8, 9, 10, 11, 12, 13, 14, 15, 16, 17, 18, 19, or 20 contiguous nucleobase portion of any one of SEQ ID NOs: 9-3246 and a second strand. In certain embodiments, the compound comprises a first strand comprising the nucleobase sequence of any one of SEQ ID NOs: 9-3246 and a second strand. In certain embodiments, the compound comprises ribonucleotides in which the first strand has uracil (U) in place of thymine (T) in any one of SEQ ID NOs: 9-3246. In certain embodiments, the compound comprises (i) a first strand comprising a nucleobase sequence complementary to the site on FOXP3 to which any of SEQ ID NOs: 9-3246 is targeted, and (ii) a second strand. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the dsRNA compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains one or two capped strands, as disclosed, for example, by WO 00/63364, filed Apr. 19, 2000.

In certain embodiments, the first strand of the compound is an siRNA guide strand and the second strand of the compound is an siRNA passenger strand. In certain embodiments, the second strand of the compound is complementary to the first strand. In certain embodiments, each strand of the compound is 16, 17, 18, 19, 20, 21, 22, or 23 linked nucleosides in length. In certain embodiments, the first or second strand of the compound can comprise a conjugate group.

In certain embodiments, a compound described herein can comprise any of the oligonucleotide sequences targeted to FOXP3 described herein. In certain embodiments, the compound is single stranded. In certain embodiments, such a compound is a single-stranded RNAi (ssRNAi) compound. In certain embodiments, the compound comprises at least an 8, 9, 10, 11, 12, 13, 14, 15, 16, 17, 18, 19, or 20 contiguous nucleobase portion of any one of SEQ ID NOs: 9-3246. In certain embodiments, the compound comprises the nucleobase sequence of any one of SEQ ID NOs: 9-3246. In certain embodiments, the compound comprises ribonucleotides in which uracil (U) is in place of thymine (T) in any one of SEQ ID NOs: 9-3246. In certain embodiments, the compound comprises a nucleobase sequence complementary to the site on FOXP3 to which any of SEQ ID NOs: 9-3246 is targeted. In certain embodiments, the compound comprises one or more modified nucleotides in which the 2' position in the sugar contains a halogen (such as fluorine group; 2'-F) or contains an alkoxy group (such as a methoxy group; 2'-OMe). In certain embodiments, the compound comprises at least one 2'-F sugar modification and at least one 2'-OMe sugar modification. In certain embodiments, the at least one 2'-F sugar modification and at least one 2'-OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the compound. In certain embodiments, the compound comprises one or more linkages between adjacent nucleotides other than a naturally-occurring phosphodiester linkage. Examples of such linkages include phosphoramide, phosphorothioate, and phosphorodithioate linkages. The compounds may also be chemically modified nucleic acid molecules as taught in U.S. Pat. No. 6,673,661. In other embodiments, the compound contains a capped strand, as disclosed, for example, by WO 00/63364, filed Apr. 19, 2000. In certain embodiments, the compound consists of 16, 17, 18, 19, 20, 21, 22, or 23 linked nucleosides. In certain embodiments, the compound can comprise a conjugate group.

In certain embodiments, compounds described herein comprise modified oligonucleotides. Certain modified oligonucleotides have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L) such as for amino acids etc. Included in the modified oligonucleotides provided herein are all such possible isomers, including their racemic and optically pure forms, unless specified otherwise. Likewise, all cis- and trans-isomers and tautomeric forms are also included.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^{1}$H hydrogen atoms. Isotopic substitutions encompassed by the compounds herein include but are not limited to: $^{2}$H or $^{3}$H in place of $^{1}$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the compound that are beneficial for use as a therapeutic or research tool. In certain embodiments, radioactive isotopic substitutions may make the compound suitable for research or diagnostic purposes, such as an imaging assay.

Certain Mechanisms

In certain embodiments, compounds described herein comprise or consist of modified oligonucleotides. In certain embodiments, compounds described herein are antisense compounds. In certain embodiments, compounds comprise oligomeric compounds. In certain embodiments, compounds described herein are capable of hybridizing to a target nucleic acid, resulting in at least one antisense activity. In certain embodiments, compounds described herein selectively affect one or more target nucleic acid. Such compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in a significant undesired antisense activity. In certain antisense activities, hybridization of a compound described herein to a target nucleic acid results in recruitment of a protein that cleaves the target nucleic acid. For example, certain compounds described herein result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, compounds described herein are sufficiently "DNA-like" to elicit RNase H activity. Further, in certain embodiments, one or more non-DNA-like nucleoside in the gap of a gapmer is tolerated.

In certain antisense activities, compounds described herein or a portion of the compound is loaded into an RNA-induced silencing complex (RISC), ultimately resulting in cleavage of the target nucleic acid. For example, certain compounds described herein result in cleavage of the target nucleic acid by Argonaute. Compounds that are loaded into RISC are RNAi compounds. RNAi compounds may be double-stranded (siRNA) or single-stranded (ssRNA).

In certain embodiments, hybridization of compounds described herein to a target nucleic acid does not result in recruitment of a protein that cleaves that target nucleic acid. In certain such embodiments, hybridization of the compound to the target nucleic acid results in alteration of splicing of the target nucleic acid. In certain embodiments, hybridization of the compound to a target nucleic acid results in inhibition of a binding interaction between the target nucleic acid and a protein or other nucleic acid. In certain such embodiments, hybridization of the compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

Target Nucleic Acids, Target Regions and Nucleotide Sequences

In certain embodiments, compounds described herein comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: an mRNA and a pre-mRNA, including intronic, exonic and untranslated regions. In certain embodiments, the target RNA is an mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron.

Nucleotide sequences that encode FOXP3 include, without limitation, the following: RefSEQ No. NM_014009.3 (SEQ ID NO: 1); NT_011568.12_TRUNC_11907130_11921808_COMP (SEQ ID NO: 2); NM_001114377.1 (SEQ ID NO: 3); NC_000023.11_TRUNC_49247001_49273000_COMP (SEQ ID NO: 4); or UCSC Accession No. UC064ZFP.1 corresponding to genomic co-ordinates chrX:49,251,334-49,259,240 on assembly GRCh38/hg38 (SEQ ID NO: 5); each of which is incorporated by reference in its entirety.

Hybridization

In some embodiments, hybridization occurs between a compound disclosed herein and a FOXP3 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Hybridization conditions are sequence-dependent and are determined by the nature and composition of the nucleic acid molecules to be hybridized.

Methods of determining whether a sequence is specifically hybridizable to a target nucleic acid are well known in the art. In certain embodiments, the compounds provided herein are specifically hybridizable with a FOXP3 nucleic acid.

Complementarity

An oligonucleotide is said to be complementary to another nucleic acid when the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to the following pairs: adenine (A) and thymine (T), adenine (A) and uracil (U), cytosine (C) and guanine (G), and 5-methyl cytosine (mC) and guanine (G) unless otherwise specified. Complementary oligonucleotides and/or nucleic acids need not have nucleobase complementarity at each nucleoside and may include one or more nucleobase mismatches. An oligonucleotide is fully complementary or 100% complementary when such oligonucleotides have nucleobase matches at each nucleoside without any nucleobase mismatches.

In certain embodiments, compounds described herein comprise or consist of modified oligonucleotides. In certain embodiments, compounds described herein are antisense compounds. In certain embodiments, compounds comprise oligomeric compounds. Non-complementary nucleobases between a compound and a FOXP3 nucleic acid may be tolerated provided that the compound remains able to specifically hybridize to a target nucleic acid. Moreover, a compound may hybridize over one or more segments of a FOXP3 nucleic acid such that intervening or adjacent segments are not involved in the hybridization event (e.g., a loop structure, mismatch or hairpin structure).

In certain embodiments, the compounds provided herein, or a specified portion thereof, are, are at least, or are up to 70%, 80%, 85%, 86%, 87%, 88%, 89%, 90%, 91%, 92%, 93%, 94%, 95%, 96%, 97%, 98%, 99%, or 100% complementary to a FOXP3 nucleic acid, a target region, target segment, or specified portion thereof. In certain embodiments, the compounds provided herein, or a specified portion thereof, are 70% to 75%, 75% to 80%, 80% to 85%, 85% to 90%, 90% to 95%, 95% to 100%, or any number in between these ranges, complementary to a FOXP3 nucleic acid, a target region, target segment, or specified portion thereof. Percent complementarity of a compound with a target nucleic acid can be determined using routine methods.

For example, a compound in which 18 of 20 nucleobases of the compound are complementary to a target region, and would therefore specifically hybridize, would represent 90 percent complementarity. In this example, the remaining non-complementary nucleobases may be clustered or interspersed with complementary nucleobases and need not be contiguous to each other or to complementary nucleobases. As such, a compound which is 18 nucleobases in length having four non-complementary nucleobases which are flanked by two regions of complete complementarity with the target nucleic acid would have 77.8% overall complementarity with the target nucleic acid. Percent complementarity of a compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, compounds described herein, or specified portions thereof, are fully complementary (i.e. 100% complementary) to a target nucleic acid, or specified portion thereof. For example, a compound may be fully complementary to a FOXP3 nucleic acid, or a target region, or a target segment or target sequence thereof. As used herein, "fully complementary" means each nucleobase of a compound is complementary to the corresponding nucleobase of a target nucleic acid. For example, a 20 nucleobase compound is fully complementary to a target sequence that is 400 nucleobases long, so long as there is a corresponding 20 nucleobase portion of the target nucleic acid that is fully complementary to the compound. Fully complementary can also be used in reference to a specified portion of the first and/or the second nucleic acid. For example, a 20 nucleobase portion of a 30 nucleobase compound can be "fully complementary" to a target sequence that is 400 nucleobases long. The 20 nucleobase portion of the 30 nucleobase compound is fully complementary to the target sequence if the target sequence has a corresponding 20 nucleobase portion wherein each nucleobase is complementary to the 20 nucleobase portion of the compound. At the same time, the entire 30 nucleobase compound may or may not be fully complementary to the target sequence, depending on whether the remaining 10 nucleobases of the compound are also complementary to the target sequence.

In certain embodiments, compounds described herein comprise one or more mismatched nucleobases relative to the target nucleic acid. In certain such embodiments, antisense activity against the target is reduced by such mismatch, but activity against a non-target is reduced by a greater amount. Thus, in certain such embodiments selectivity of the compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap region. In certain such embodiments, the mismatch is at position 9, 8, 7, 6, 5, 4, 3, 2, 1 from the 3'-end of the gap region. In certain such embodiments, the mismatch is at position 1, 2, 3, or 4 from the 5'-end of the wing region. In certain such embodiments, the mismatch is at position 4, 3, 2, or 1 from the 3'-end of the wing region. In certain embodiments, the mismatch is specifically positioned within an oligonucleotide not having a gapmer motif. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

The location of a non-complementary nucleobase may be at the 5' end or 3' end of the compound. Alternatively, the non-complementary nucleobase or nucleobases may be at an internal position of the compound. When two or more non-complementary nucleobases are present, they may be contiguous (i.e. linked) or non-contiguous. In one embodiment, a non-complementary nucleobase is located in the wing segment of a gapmer oligonucleotide.

In certain embodiments, compounds described herein that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a FOXP3 nucleic acid, or specified portion thereof.

In certain embodiments, compounds described herein that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a FOXP3 nucleic acid, or specified portion thereof.

In certain embodiments, compounds described herein also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of a compound. In certain embodiments, the— compounds, are complementary to at least an 8 nucleobase portion of a target segment. In certain embodiments, the compounds are complementary to at least a 9 nucleobase portion of a target segment. In certain embodiments, the compounds are complementary to at least a 10 nucleobase portion of a target segment. In certain embodiments, the compounds are complementary to at least an 11 nucleobase portion of a target segment. In certain embodiments, the compounds are complementary to at least a 12 nucleobase portion of a target segment. In certain embodiments, the compounds are complementary to at least a 13 nucleobase portion of a target segment.

In certain embodiments, the compounds are complementary to at least a 14 nucleobase portion of a target segment. In certain embodiments, the compounds are complementary to at least a 15 nucleobase portion of a target segment. In certain embodiments, the compounds are complementary to at least a 16 nucleobase portion of a target segment. Also contemplated are compounds that are complementary to at least a 9, 10, 11, 12, 13, 14, 15, 16, 17, 18, 19, 20, or more nucleobase portion of a target segment, or a range defined by any two of these values.

Identity

The compounds provided herein may also have a defined percent identity to a particular nucleotide sequence, SEQ ID NO, or compound represented by a specific ION number, or portion thereof. In certain embodiments, compounds described herein are antisense compounds or oligomeric compounds. In certain embodiments, compounds described herein are modified oligonucleotides. As used herein, a compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the compounds described herein as well as compounds having non-identical bases relative to the compounds provided herein also are contemplated. The non-identical bases may be adjacent to each other or dispersed throughout the compound. Percent identity of an compound is calculated according to the number of bases that have identical base pairing relative to the sequence to which it is being compared.

In certain embodiments, compounds described herein, or portions thereof, are, or are at least, 70%, 75%, 80%, 85%, 90%, 91%, 92%, 93%, 94%, 95%, 96%, 97%, 98%, 99% or 100% identical to one or more of the compounds or SEQ ID NOs, or a portion thereof, disclosed herein. In certain embodiments, compounds described herein are about 70%, 75%, 80%, 85%, 90%, 91%, 92%, 93%, 94%, 95%, 96%, 97%, 98%, or 99% identical, or any percentage between such values, to a particular nucleotide sequence, SEQ ID NO, or compound represented by a specific ION number, or portion thereof, in which the compounds comprise an oligonucleotide having one or more mismatched nucleobases. In certain such embodiments, the mismatch is at position 1, 2, 3, 4, 5, 6, 7, 8, 9, 10, 11, or 12 from the 5'-end of the oligonucleotide. In certain such embodiments, the mismatch is at position, 2, 3, 4, 5, 6, 7, 8, 9, 10, 11, or 12 from the 3'-end of the oligonucleotide.

In certain embodiments, compounds described herein comprise or consist of antisense compounds. In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, compounds described herein comprise or consist of oligonucleotides. In certain embodiments, a portion of the oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Certain Modified Compounds

In certain embodiments, compounds described herein comprise or consist of oligonucleotides consisting of linked nucleosides. Oligonucleotides may be unmodified oligonucleotides (RNA or DNA) or may be modified oligonucleotides. Modified oligonucleotides comprise at least one modification relative to unmodified RNA or DNA (i.e., comprise at least one modified nucleoside (comprising a modified sugar moiety and/or a modified nucleobase) and/or at least one modified internucleoside linkage).

A. Modified Nucleosides

Modified nucleosides comprise a modified sugar moiety or a modified nucleobase or both a modifed sugar moiety and a modified nucleobase.

1. Modified Sugar Moieties

In certain embodiments, sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more acyclic substituent, including but not limited to substituents at the 2', 4', and/or 5' positions. In certain embodiments one or more acyclic substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for linearly non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugars comprise more than one non-bridging sugar substituent, for example, 2'-F-5'-methyl sugar moieties and the modified sugar moieties and modified nucleosides described in Migawa et al., US2010/190837 and Rajeev et al., US2013/0203836.

In certain embodiments, a 2'-substituted nucleoside or 2'-non-bicyclic modified nucleoside comprises a sugar moiety comprising a linear 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside or 2'-non-bicyclic modified nucleoside comprises a sugar moiety comprising a linear 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted nucleoside or 2'-non-bicyclic modified nucleoside comprises a sugar moiety comprising a linear 2'-substituent group selected from: F, OCH$_3$, and OCH$_2$CH$_2$OCH$_3$.

Nucleosides comprising modified sugar moieties, such as non-bicyclic modified sugar moieties, are referred to by the position(s) of the substitution(s) on the sugar moiety of the nucleoside. For example, nucleosides comprising 2'-substituted or 2-modified sugar moieties are referred to as 2'-substituted nucleosides or 2-modified nucleosides.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt" when in the S configuration), 4'-CH$_2$—O—CH$_2$-2', 4'-CH$_2$—N(R)-2', 4'-CH(CH$_2$OCH$_3$)—O-2' ("constrained MOE" or "cMOE") and analogs thereof (see. e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see. e.g., Seth et al., U.S. Pat. No. 8,278,283), 4'-CH$_2$—N(OCH$_3$)-2' and analogs thereof (see. e.g., Prakash et al., U.S. Pat. No. 8,278,425), 4'-CH$_2$—O—N(CH$_3$)-2' (see. e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., J. Org. Chem., 2009, 74, 118-134), 4'-CH$_2$—C(=CH$_2$)-2' and analogs thereof (see e.g., Seth et al., U.S. Pat. No. 8,278,426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O-2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]—, —[C(R$_a$)(R$_b$)]—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_b$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., Nucleic Acids Research, 1997, 25(22), 4429-4443, Albaek et al., J. Org. Chem., 2006, 71, 7731-7740, Singh et al., Chem. Commun., 1998, 4, 455-456; Koshkin et al., Tetrahedron, 1998, 54, 3607-3630; Wahlestedt et al., Proc. Natl. Acad. Sci. U.S.A, 2000, 97, 5633-5638; Kumar et al., Bioorg. Med. Chem. Lett., 1998, 8, 2219-2222; Singh et al., J. Org. Chem., 1998, 63, 10035-10039; Srivastava et al., J. Am. Chem. Soc., 2007, 129. 8362-8379; Elayadi et al., Curr. Opinion Invens. Drugs. 2001, 2, 558-561; Braasch et al., Chem. Biol., 2001, 8, 1-7; Orum et al., Curr. Opinion Mol. Ther., 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; Allerson et al., US2008/0039618; and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

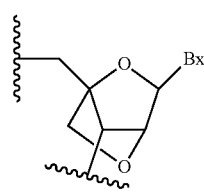

LNA (β-D-configuration) bridge =
4'-CH$_2$—O-2'

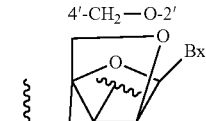

α-L-LNA (α-L-configuration) bridge =
4'-CH$_2$—O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*. 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see e.g., Leumann, C J. *Bioorg. & Med. Chem.* 2002, 10, 841-854), fluoro HNA:

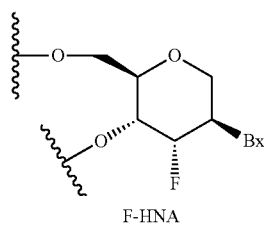

F-HNA ("F-HNA", see e.g., Swayze et al., U.S. Pat. No. 8,088,904; Swayze et al., U.S. Pat. No. 8,440,803; and Swayze et al., U.S. Pat. No. 9,005,906, F-HNA can also be referred to as a F-THP or 3'-fluoro tetrahydropyran), and nucleosides comprising additional modified THP compounds having the formula:

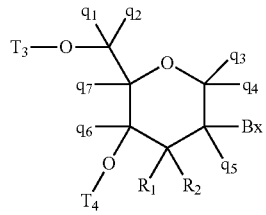

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., *Biochemistry*, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

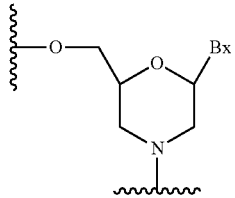

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.*, 2013, 11, 5853-5865), and nucleosides and oligonucleotides described in Manoharan et al., US2013/130378.

Many other bicyclic and tricyclic sugar and sugar surrogate ring systems are known in the art that can be used in modified nucleosides.

2. Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds.

In certain embodiments, compounds described herein comprise modified oligonucleotides. In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimi-dines, alkyl or alkynyl substituted pyrimidines, alkyl substituted purines, and N-2, N-6 and 0-6 substituted purines. In certain embodiments, modified nucleobases are selected from: 2-aminopropyladenine, 5-hydroxymethyl cytosine, 5-methylcytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (C=C—CH3) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia Of Polymer Science And Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403, Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

In certain embodiments, compounds targeted to a FOXP3 nucleic acid comprise one or more modified nucleobases. In certain embodiments, the modified nucleobase is 5-methylcytosine. In certain embodiments, each cytosine is a 5-methylcytosine.

3. Modified Internucleoside Linkages

The naturally occurring internucleoside linkage of RNA and DNA is a 3' to 5' phosphodiester linkage In certain embodiments, compounds described herein having one or more modified, i.e. non-naturally occurring, internucleoside linkages are often selected over compounds having naturally occurring internucleoside linkages because of desirable properties such as, for example, enhanced cellular uptake, enhanced affinity for target nucleic acids, and increased stability in the presence of nucleases.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration.

In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

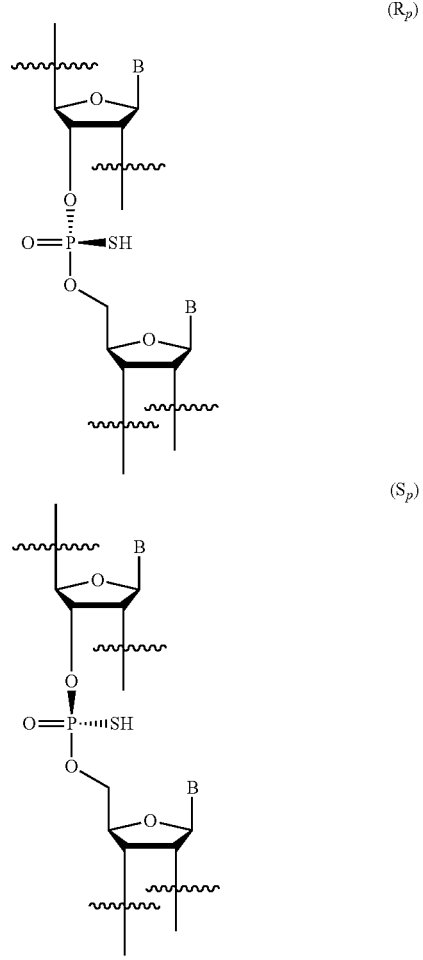

Unless otherwise indicated, chiral internucleoside linkages of modified oligonucleotides described herein can be stereorandom or in a particular stereochemical configuration.

In certain embodiments, compounds targeted to an FOXP3 nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

In certain embodiments, compounds described herein comprise oligonucleotides. Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS-P=S"). Representative non-phosphorus containing internucleoside linking groups include but are not limited to methylenemethylimino (—CH2-N(CH3)-O-CH2-), thiodiester, thionocarbamate (—O—C(=O)(NH)—S—); siloxane (—O—SiH2-O—); and N,N'-dimethylhydrazine (—CH2-N(CH3)-N(CH3)-). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Representative chiral internucleoside linkages include but are not limited to alkylphosphonates and phosphorothioates. Methods of preparation of phosphorous-containing and non-phosphorous-containing internucleoside linkages are well known to those skilled in the art.

Neutral internucleoside linkages include, without limitation, phosphotriesters, methylphosphonates, MMI (3'-CH2-N(CH3)-O-5'), amide-3 (3'-CH2-C(=O)—N(H)-5'), amide-4 (3'-CH2-N(H)—C(=O)-5'), formacetal (3'-O-CH2-O-5'), methoxypropyl, and thioformacetal (3'-S-CH2-O-5'). Further neutral internucleoside linkages include nonionic linkages comprising siloxane (dialkylsiloxane), carboxylate ester, carboxamide, sulfide, sulfonate ester and amides (See for example: Carbohydrate Modifications in Antisense Research; Y. S. Sanghvi and P. D. Cook, Eds., ACS Symposium Series 580; Chapters 3 and 4, 40-65). Further neutral internucleoside linkages include nonionic linkages comprising mixed N, O, S and CH2 component parts.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosponate linkages. In certain embodiments, oligonucleotides having a gapmer nucleoside motif comprise a linkage motif comprising all phosphorothioate linkages except for one or two methylphosponate linkages. In certain embodiments, one methylphosponate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

Certain Motifs

In certain embodiments, compounds described herein comprise oligonucleotides. Oligonucleotides can have a motif, e.g. a pattern of unmodified and/or modified sugar moieties, nucleobases, and/or internucleoside linkages. In certain embodiments, modified oligonucleotides comprise one or more modified nucleoside comprising a modified sugar. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

a. Certain Sugar Motifs

In certain embodiments, compounds described herein comprise oligonucleotides. In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which comprises two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, the wings of a gapmer comprise 2-5 nucleosides. In certain embodiments, the wings of a gapmer comprise 3-5 nucleosides. In certain embodiments, the nucleosides of a gapmer are all modified nucleosides.

In certain embodiments, the gap of a gapmer comprises 7-12 nucleosides. In certain embodiments, the gap of a gapmer comprises 7-10 nucleosides. In certain embodiments, the gap of a gapmer comprises 8-10 nucleosides. In certain embodiments, the gap of a gapmer comprises 10 nucleosides. In certain embodiment, each nucleoside of the gap of a gapmer is an unmodified 2'-deoxy nucleoside.

In certain embodiments, the gapmer is a deoxy gapmer. In such embodiments, the nucleosides on the gap side of each wing/gap junction are unmodified 2'-deoxy nucleosides and the nucleosides on the wing sides of each wing/gap junction are modified nucleosides. In certain such embodiments, each nucleoside of the gap is an unmodified 2'-deoxy nucleoside. In certain such embodiments, each nucleoside of each wing is a modified nucleoside.

In certain embodiments, a modified oligonucleotide has a fully modified sugar motif wherein each nucleoside of the modified oligonucleotide comprises a modified sugar moiety. In certain embodiments, modified oligonucleotides comprise or consist of a region having a fully modified sugar motif wherein each nucleoside of the region comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

In certain embodiments, a modified oligonucleotide can comprise a sugar motif described in Swayze et al., US2010/0197762; Freier et al., US2014/0107330; Freier et al., US2015/0184153; and Seth et al., US2015/0267195, each of which is incorporated by reference in its entirety herein.

Certain embodiments provided herein are directed to modified oligomeric compounds useful for inhibiting target nucleic acid expression, which can be useful for treating, preventing, ameliorating, or slowing progression of a disease associated with such a target nucleic acid. In certain embodiments, the modified oligomeric compounds comprise antisense oligonucleotides that are gapmers having certain sugar motifs. In certain embodiments, the gapmer sugar motifs provided herein can be combined with any nucleobase sequence and any internucleoside linkage motif to form potent antisense oligonucleotides.

In certain embodiments, a method comprises contacting a cell or administering to a subject a compound comprising a modified oligonucleotide 16 linked nucleosides in length having the motif: ekk-d9-kkee, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide 16 linked nucleosides in length having the motif: k-d9-kekeke, wherein 'd' represents a 2'-deoxyribose sugar, 'k' represents a cEt nucleoside, and 'e' represents a 2'-MOE nucleoside.

In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide 16 linked nucleosides in length having the motif: kkk-d8-kekek, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer.

In certain embodiments, administering the compound to the subject treats the subject's cancer.

In certain embodiments, a method comprises contacting a cell or administering to a subject a compound comprising a modified oligonucleotide 16 linked nucleosides in length having the motif: kkk-d9-keke, wherein 'd' represents a 2'-deoxyribose sugar, 'k' represents a cEt nucleoside, and 'e' represents a 2'-MOE nucleoside.

In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide 16 linked nucleosides in length having the motif: kk-d9-kdkdk, wherein 'd' represents a 2'-deoxyribose sugar, 'k' represents a cEt nucleoside, and 'e' represents a 2'-MOE nucleoside.

In certain embodiments, the cell is a cancer cell. In certain embodiments, the subject has cancer. In certain embodiments, administering the compound to the subject treats the subject's cancer.

In certain embodiments, a compound comprises a modified oligonucleotide 16 linked nucleosides in length having the motif: kk-d9-eeekk, wherein 'd' represents a 2'-deoxyribose sugar, 'k' represents a cEt nucleoside, and 'e' represents a 2'-MOE nucleoside. In certain embodiments, a method comprises contacting a cell or administering to a subject a compound comprising a modified oligonucleotide 16 linked nucleosides in length having the motif: kk-d9-eeekk, wherein 'd' represents a 2'-deoxyribose sugar, 'k' represents a cEt nucleoside, and 'e' represents a 2'-MOE nucleoside. In certain embodiments, the cell is a cancer cell. In certain embodiments, the subject has cancer. In certain embodiments, administering the compound to the subject treats the subject's cancer.

In certain embodiments, a method comprises contacting a cell or administering to a subject a compound comprising a modified oligonucleotide 16 linked nucleosides in length having the motif: kk-d9-ekeke, wherein 'd' represents a 2'-deoxyribose sugar, 'k' represents a cEt nucleoside, and 'e' represents a 2'-MOE nucleoside.

In certain embodiments, the cell is a cancer cell. In certain embodiments, the subject has cancer. In certain embodiments, administering the compound to the subject treats the subject's cancer.

b. Certain Nucleobase Motifs

In certain embodiments, compounds described herein comprise oligonucleotides. In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

c. Certain Internucleoside Linkage Motifs

In certain embodiments, compounds described herein comprise oligonucleotides. In certain embodiments, oligonucleotides comprise modified and/or unmodified internucleoside linkages arranged along the oligonucleotide or region thereof in a defined pattern or motif. In certain embodiments, essentially each internucleoside linking group is a phosphate internucleoside linkage (P=O). In certain embodiments, each internucleoside linking group of a modified oligonucleotide is a phosphorothioate (P=S). In certain embodiments, each internucleoside linking group of a modified oligonucleotide is independently selected from a phosphorothioate and phosphate internucleoside linkage. In certain embodiments, the sugar motif of a modified oligonucleotide is a gapmer and the internucleoside linkages within the gap are all modified. In certain such embodiments, some or all of the internucleoside linkages in the wings are unmodified phosphate linkages.

In certain embodiments, the terminal internucleoside linkages are modified.

4. Certain Modified Oligonucleotides

In certain embodiments, compounds described herein comprise modified oligonucleotides. In certain embodiments, the above modifications (sugar, nucleobase, internucleoside linkage) are incorporated into a modified oligonucleotide. In certain embodiments, modified oligonucleotides are characterized by their modification, motifs, and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such gapmer oligonucleotides may comprise one or more modified nucleobase independent of the gapmer pattern of the sugar modifications. Furthermore, in certain instances, an oligonucleotide is described by an overall length or range and by lengths or length ranges of two or more regions (e.g., a regions of nucleosides having specified sugar modifications), in such circumstances it may be possible to select numbers for each range that result in an oligonucleotide having an overall length falling outside the specified range. In such circumstances, both elements must be satisfied. For example, in certain embodiments, a modified oligonucleotide consists of 15-20 linked nucleosides and has a sugar motif consisting of three regions, A, B, and C, wherein region A consists of 2-6 linked nucleosides having a specified sugar motif, region B consists of 6-10 linked nucleosides having a specified sugar motif, and region C consists of 2-6 linked nucleosides having a specified sugar motif. Such embodiments do not include modified oligonucleotides where A and C each consist of 6 linked nucleosides and B consists of 10 linked nucleosides (even though those numbers of nucleosides are permitted within the requirements for A, B, and C) because the overall length of such oligonucleotide is 22, which exceeds the upper limit of the overall length of the modified oligonucleotide (20). Herein, if a description of an oligonucleotide is silent with respect to one or more parameter, such parameter is not limited. Thus, a modified oligonucleotide described only as having a gapmer sugar motif without further description may have any length, internucleoside linkage motif, and nucleobase motif. Unless otherwise indicated, all modifications are independent of nucleobase sequence.

Certain Conjugated Compounds

In certain embodiments, the compounds described herein comprise or consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

In certain embodiments, the oligonucleotide is modified. In certain embodiments, the oligonucleotide of a compound has a nucleobase sequence that is complementary to a target nucleic acid. In certain embodiments, oligonucleotides are complementary to a messenger RNA (mRNA). In certain embodiments, oligonucleotides are complementary to a sense transcript.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance In certain embodiments, conjugate groups impart a new property on the attached oligonucleotide, e.g., fluorophores or reporter groups that enable detection of the oligonucleotide.

Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N Y. Acad. Sci.,* 1992, 660, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO J.,* 1991, 10, 1111-1118; Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H- phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic, a palmityl moiety (Mishra et al., *Biochim. Biophys. Acta*, 1995, 1264. 229-237), an octadecylamine or hexylamino-carbonyl-oxycholesterol moiety (Crooke et al., *J. Pharmacol. Exp. Ther.*, 1996, i, 923-937), a tocopherol group (Nishina et al., *Molecular Therapy Nucleic Acids*, 2015, 4, e220; doi: 10.1038/mtna.2014.72 and Nishina et al., *Molecular Therapy*. 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2 Conjugate Linkers

Conjugate moieties are attached to oligonucleotides through conjugate linkers. In certain compounds, a conjugate group is a single chemical bond (i.e. conjugate moiety is attached to an oligonucleotide via a conjugate linker through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the compound after it reaches a target tissue. Accordingly, linker-nucleosides are typically linked to one another and to the remainder of the compound through cleavable bonds.

In certain embodiments, such cleavable bonds are phosphodiester bonds.

Herein, linker-nucleosides are not considered to be part of the oligonucleotide. Accordingly, in embodiments in which a compound comprises an oligonucleotide consisting of a specified number or range of linked nucleosides and/or a specified percent complementarity to a reference nucleic acid and the compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, a compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such a compound is more than 30. Alternatively, an compound may comprise a modified oligonucleotide consisting of 8-30 nucleosides and no conjugate group. The total number of contiguous linked nucleosides in such a compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances compounds comprising a particular conjugate moiety are better taken up by a particular cell type, but once the compound has been taken up, it is desirable that the conjugate group be cleaved to release the unconjugated or parent oligonucleotide. Thus, certain conjugate may comprise one or more cleavable moieties, typically within the conjugate linker. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, one or more linker-nucleosides are linked to one another and/or to the remainder of the compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

Compositions and Methods for Formulating Pharmaceutical Compositions

Compounds described herein may be admixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

Certain embodiments provide pharmaceutical compositions comprising one or more compounds or a salt thereof. In certain embodiments, the compounds are antisense compounds or oligomeric compounds. In certain embodiments, the compounds comprise or consist of a modified oligonucleotide. In certain such embodiments, the pharmaceutical composition comprises a suitable pharmaceutically acceptable diluent or carrier. In certain embodiments, a pharmaceutical composition comprises a sterile saline solution and one or more compound. In certain embodiments, such pharmaceutical composition consists of a sterile saline solution and one or more compound. In certain embodiments, the sterile saline is pharmaceutical grade saline. In certain embodiments, a pharmaceutical composition comprises one or more compound and sterile water. In certain embodiments, a pharmaceutical composition consists of one compound and sterile water. In certain embodiments, the sterile water is pharmaceutical grade water. In certain embodiments, a pharmaceutical composition comprises one or more compound and phosphate-buffered saline (PBS). In certain embodiments, a pharmaceutical composition consists of one or more compound and sterile PBS. In certain embodiments, the sterile PBS is pharmaceutical grade PBS. Compositions and methods for the formulation of pharmaceutical compositions are dependent upon a number of criteria, including, but not limited to, route of administration, extent of disease, or dose to be administered.

A compound described herein targeted to FOXP3 nucleic acid can be utilized in pharmaceutical compositions by combining the compound with a suitable pharmaceutically acceptable diluent or carrier. In certain embodiments, a pharmaceutically acceptable diluent is water, such as sterile water suitable for injection. Accordingly, in one embodiment, employed in the methods described herein is a pharmaceutical composition comprising a compound targeted to FOXP3 nucleic acid and a pharmaceutically acceptable diluent. In certain embodiments, the pharmaceutically acceptable diluent is water. In certain embodiments, the compound comprises or consists of a modified oligonucleotide provided herein.

Pharmaceutical compositions comprising compounds provided herein encompass any pharmaceutically acceptable salts, esters, or salts of such esters, or any other oligonucleotide which, upon administration to an animal, including a human, is capable of providing (directly or indirectly) the biologically active metabolite or residue thereof. In certain embodiments, the compounds are antisense compounds or oligomeric compounds. In certain embodiments, the compound comprises or consists of a modified oligonucleotide. Accordingly, for example, the disclosure is also drawn to pharmaceutically acceptable salts of compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of a compound which are cleaved by endogenous nucleases within the body, to form the active compound.

In certain embodiments, the compounds or compositions further comprise a pharmaceutically acceptable carrier or diluent.

EXAMPLES

The Examples below describe the screening process to identify lead compounds targeted to FOXP3. Out of over 3,000 oligonucleotides that were screened, ION 1062428, 1062641, 1062835, 1062937, 1063268, 1063649, 1063655, 1063734, 1064096, or 1064313 emerged as the top lead compounds.

Non-Limiting Disclosure and Incorporation by Reference

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA) or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGATCG" and compounds having other modified nucleobases, such as "AT$^m$CGAUCG," wherein $^m$C indicates a cytosine base comprising a methyl group at the 5-position.

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Antisense Inhibition of Human Foxp3 in LNCaP Cells by cEt Gapmers

Modified oligonucleotides were designed to target a Foxp3 nucleic acid and were tested for their effect on Foxp3 mRNA level in vitro. The modified oligonucleotides were tested in a series of experiments that had similar culture conditions. The results for each experiment are presented in separate tables shown below. Cultured LNCaP cells at a density of 30,000 cells per well were transfected using electroporation with 3,000 nM of modified oligonucleotide. After a treatment period of approximately 24 hours, RNA was isolated from the cells and Foxp3 mRNA levels were measured by quantitative real-time RTPCR. Human primer probe set RTS35925 (forward sequence CTACTT-CAAGTTCCACAACATGC, designated herein as SEQ ID NO.: 6; reverse sequence CCAGTGGTAGATCTCATT-GAGTG; designated herein as SEQ ID NO.: 7; probe sequence CCTTTCACCTACGCCACGCTCAT, designated herein as SEQ ID NO.: 8) was used to measure mRNA levels. Foxp3 mRNA levels were adjusted according to total RNA content, as measured by RIBOGREEN®. Results are presented in the tables below as percent control of the amount of Foxp3 mRNA relative to untreated control cells (% UTC). The modified oligonucleotides with percent control values marked with an asterisk (*) target the amplicon region of the primer probe set. Additional assays may be used to measure the potency and efficacy of the modified oligonucleotides targeting the amplicon region.

The newly designed modified oligonucleotides in the Tables below were designed as 3-10-3 cEt gapmers. The gapmers are 16 nucleosides in length, wherein the central gap segment comprises of ten 2'-deoxynucleosides and is flanked by wing segments on the 5' direction and the 3' direction comprising three nucleosides each. Each nucleoside in the 5' wing segment and each nucleoside in the 3' wing segment has a cEt sugar modification. The internucleoside linkages throughout each gapmer are phosphorothioate (P=S) linkages. All cytosine residues throughout each gapmer are 5-methylcytosines.

"Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either SEQ ID NO.: 1 (GENBANK Accession No. NM_014009.3), or SEQ ID NO.: 2 (the complement of GENBANK Accession No. NT_011568.12 truncated from nucleotides 11907130 to Ser. No. 11/921,808), or SEQ ID No.: 3 (GENBANK Accession No. NM_001114377.1), or SEQ ID No.: 4 (the complement of GENBANK Accession No. NC_000023.11 truncated from nucleotides 49247001 to 49273000), or SEQ ID No. 5 (UCSC Accession No. UC064ZFP.1 corresponding to genomic co-ordinates chrX:49,251,334-49,259,240 on assembly GRCh38/hg38). 'N/A' indicates that the modified oligonucleotide does not target that particular gene sequence with 100% complementarity. 'N.D.' indicates that the % UTC is not defined for that particular modified oligonucleotide in that particular experiment. Activity of that modified oligonucleotide may be defined in a different experiment.

TABLE 1

Inhibition of Foxp3 mRNA by 3-10-3 cEt gapmers targeting SEQ ID NO.: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 895287 | 1168 | 1183 | 12038 | 12053 | TTGAAGTAGTCCATGT | 58* | 9 |
| 910921 | 7 | 22 | 407 | 422 | ATTTTTTTCGATGAGT | 49 | 10 |
| 910925 | 77 | 92 | 477 | 492 | TTTTATACCGAGAAGA | 45 | 11 |
| 910929 | 376 | 391 | 6914 | 6929 | TGCGATGGTGGCATGG | 44 | 12 |
| 910933 | 564 | 579 | 7727 | 7742 | GGCTGATCATGGCTGG | 35 | 13 |
| 910937 | 765 | 780 | 8411 | 8426 | CACCATTTGCCAGCAG | 50 | 14 |
| 910941 | 1000 | 1015 | N/A | N/A | TCGGATGATGCCACAG | 42 | 15 |
| 910945 | 1144 | 1159 | N/A | N/A | AACTCTGGGAATGTGC | 72 | 16 |
| 910949 | 1416 | 1431 | 13826 | 13841 | TGCGGAACTCCAGCTC | 127 | 17 |
| 910953 | 1591 | 1606 | 14001 | 14016 | GTGGAAACCTCACTTC | 62 | 18 |
| 910957 | 1802 | 1817 | 14212 | 14227 | GAAGTAATCTGTGCGA | 37 | 19 |
| 910961 | 2114 | 2129 | 14524 | 14539 | GAATTCTAACAGGCCG | 36 | 20 |
| 910965 | 2216 | 2231 | 14626 | 14641 | GGTATTTTGGCAAGG | 23 | 21 |

TABLE 1-continued

Inhibition of Foxp3 mRNA by 3-10-3 cEt gapmers targeting SEQ ID NO.: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910969 | 2336 | 2351 | N/A | N/A | CGGTACTGTGGGTTGG | 19 | 22 |
| 910973 | 1851 | 1866 | 14261 | 14276 | AGGGACAGGATTGTGA | 54 | 23 |
| 910977 | 726 | 741 | N/A | N/A | CCGAAAGGGTGCTGTC | 81 | 24 |
| 910981 | 164 | 179 | N/A | N/A | GTCCAAGGGCAGGCTT | 44 | 25 |
| 910985 | 618 | 633 | 7781 | 7796 | GGCCAGGCCGGGCCTT | 88 | 26 |
| 910989 | 63 | 78 | 463 | 478 | GAAAAACCACGCTGTA | 65 | 27 |
| 910993 | 772 | 787 | 8418 | 8433 | TTGCAGACACCATTTG | 88 | 28 |
| 911000 | 1267 | 1282 | 13497 | 13512 | TGGTAGATCTCATTGA | 69* | 29 |
| 911004 | 2108 | 2123 | 14518 | 14533 | TAACAGGCCGTGTGTG | 72 | 30 |
| 911008 | 1859 | 1874 | 14269 | 14284 | GTTGAGTGAGGGACAG | 54 | 31 |
| 911012 | 2272 | 2287 | N/A | N/A | AGGCATGGATCAGGGC | 32 | 32 |
| 911016 | 57 | 72 | 457 | 472 | CCACGCTGTACGGTGT | 39 | 33 |
| 911020 | 1257 | 1272 | 13487 | 13502 | CATTGAGTGTCCGCTG | 65* | 34 |
| 911024 | 382 | 397 | 6920 | 6935 | TGCAGCTGCGATGGTG | 59 | 35 |
| 911028 | 1741 | 1756 | 14151 | 14166 | GGCTGCAGGGCTCGAC | 25 | 36 |
| 911032 | 55 | 70 | 455 | 470 | ACGCTGTACGGTGTGG | 17 | 37 |
| 911036 | 898 | 913 | 9488 | 9503 | AGAGACTGTACCATCT | 121 | 38 |
| 911040 | 2112 | 2127 | 14522 | 14537 | ATTCTAACAGGCCGTG | 55 | 39 |
| 911044 | 2110 | 2125 | 14520 | 14535 | TCTAACAGGCCGTGTG | 56 | 40 |
| 911048 | 770 | 785 | 8416 | 8431 | GCAGACACCATTTGCC | 95 | 41 |
| 911052 | 163 | 178 | N/A | N/A | TCCAAGGGCAGGCTTG | 76 | 42 |
| 911056 | 2282 | 2297 | N/A | N/A | GTCTAAGCTGAGGCAT | 51 | 43 |
| 911060 | 133 | 148 | 533 | 548 | CAGAAAAGGATCAGCC | 63 | 44 |
| 911064 | 900 | 915 | 9490 | 9505 | CCAGAGACTGTACCAT | 90 | 45 |
| 911068 | N/A | N/A | 8373 | 8388 | GCCGAAAGGGTGCTGG | 73 | 46 |
| 911072 | N/A | N/A | 13638 | 13653 | TGCCTATGAGCCCAGA | 106 | 47 |
| 911076 | N/A | N/A | 13697 | 13712 | CGTCAACCTCTGAGGC | 111 | 48 |
| 911080 | N/A | N/A | 658 | 673 | GTACATCCCACTGTAC | 90 | 49 |
| 911084 | N/A | N/A | 1386 | 1401 | GACAATGGTGTGAAGT | 36 | 50 |
| 911088 | N/A | N/A | 1569 | 1584 | CTAATTTGGTTACAGA | 39 | 51 |
| 911092 | N/A | N/A | 2137 | 2152 | GTTAATAACCATTCCA | 50 | 52 |
| 911096 | N/A | N/A | 2390 | 2405 | CTCTATAGTAAATGGA | 78 | 53 |
| 911100 | N/A | N/A | 2663 | 2678 | TAAAATGCCCAGATCC | 54 | 54 |
| 911104 | N/A | N/A | 3219 | 3234 | TGACAATTGCCCCTCT | 115 | 55 |
| 911108 | N/A | N/A | 3358 | 3373 | TGCATTTCGGTGAGGC | 44 | 56 |
| 911112 | N/A | N/A | 4082 | 4097 | AGATTTAAAGGATCCT | 60 | 57 |

TABLE 1-continued

Inhibition of Foxp3 mRNA by 3-10-3 cEt gapmers targeting SEQ ID NO.: 1 and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911116 | N/A | N/A | 4291 | 4306 | TGACATGGGTGCTGGT | 45 | 58 |
| 911120 | N/A | N/A | 5167 | 5182 | GGTATTAAGTTCTTAG | 21 | 59 |
| 911124 | N/A | N/A | 5704 | 5719 | GCTCATGCTACACCCC | 37 | 60 |
| 911128 | N/A | N/A | 5966 | 5981 | TGGATTGGGTGCAAAA | 60 | 61 |
| 911132 | N/A | N/A | 6111 | 6126 | GACTTAATCTGAAGCT | 50 | 62 |
| 911136 | N/A | N/A | 6376 | 6391 | CACTTGAGAGCTGTTT | 70 | 63 |
| 911140 | N/A | N/A | 6642 | 6657 | TGAGATACTCGACCAC | 95 | 64 |
| 911144 | N/A | N/A | 7355 | 7370 | TGCTATGATCATCCCC | 24 | 65 |
| 911148 | N/A | N/A | 7644 | 7659 | GCACATGTGGGCTGTG | 69 | 66 |
| 911152 | N/A | N/A | 7964 | 7979 | ATCTTTAAGGTTCTGC | 23 | 67 |
| 911156 | N/A | N/A | 8561 | 8576 | CTACTTATTGGGATGA | 50 | 68 |
| 911160 | N/A | N/A | 8686 | 8701 | CTTATTATACATACGA | 77 | 69 |
| 911164 | N/A | N/A | 8824 | 8839 | GATTCTAGAGCCTGGC | 39 | 70 |
| 911168 | N/A | N/A | 9505 | 9520 | GCATTACCTGCTGCTC | 85 | 71 |
| 911172 | N/A | N/A | 9603 | 9618 | CTTTATACCAGCCCTC | 68 | 72 |
| 911176 | N/A | N/A | 9878 | 9893 | CCTGAATGTGAGGTTA | 51 | 73 |
| 911180 | N/A | N/A | 10317 | 10332 | TGCTTTAACAACTCAG | 16 | 74 |
| 911184 | N/A | N/A | 10546 | 10561 | TACATTCGCATCATGA | 33 | 75 |
| 911188 | N/A | N/A | 10690 | 10705 | GTATTTATTAGAGCAC | 59 | 76 |
| 911192 | N/A | N/A | 11343 | 11358 | AGGATTAGGAGCTTGG | 33 | 77 |
| 911196 | N/A | N/A | 11615 | 11630 | GAATTACTTAGCAGGG | 47 | 78 |
| 911200 | N/A | N/A | 11825 | 11840 | CCAAAATAGTTCTCCC | 49 | 79 |
| 911204 | N/A | N/A | 11885 | 11900 | AGGTACTGTTTGCTGA | 65 | 80 |
| 911208 | N/A | N/A | 12242 | 12257 | CACATTTGAGGCACGG | 42 | 81 |
| 911212 | N/A | N/A | 12289 | 12304 | AGGTTTGGATTTGCGG | 45 | 82 |
| 911216 | N/A | N/A | 12398 | 12413 | GGCTATTTTATGGGTC | 64 | 83 |
| 911220 | N/A | N/A | 12706 | 12721 | GGGAATATCTGGTATC | 62 | 84 |
| 911224 | N/A | N/A | 12812 | 12827 | GATCAGTTTGGATTCA | 63 | 85 |
| 911228 | N/A | N/A | 12898 | 12913 | GGACATGGTTAGGTGG | 61 | 86 |

TABLE 2

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910922 | 11 | 26 | 411 | 426 | CCAAATTTTTTCGAT | 61 | 87 |
| 910926 | 80 | 95 | 480 | 495 | TGCTTTTATACCGAGA | 11 | 88 |
| 910930 | 485 | 500 | 7550 | 7565 | GTGCATGAAATGTGGC | 25 | 89 |
| 910934 | 694 | 709 | 8271 | 8286 | GGATTTGGGAAGGTGC | 59 | 90 |
| 910938 | 873 | 888 | 9463 | 9478 | GGAGACATTGTGCCCT | 45 | 91 |
| 910942 | 1022 | 1037 | 11178 | 11193 | TACGATGCAGCAGGAG | 59 | 92 |
| 910946 | 1174 | 1189 | 12044 | 12059 | TGGAACTTGAAGTAGT | 24* | 93 |
| 910950 | 1434 | 1449 | 13844 | 13859 | GCCTCTGGCTCCGTTT | 126 | 94 |
| 910954 | 1656 | 1671 | 14066 | 14081 | CAAAGGATATGATGGG | 76 | 95 |
| 910958 | 1896 | 1911 | 14306 | 14321 | GTGTACTGAGGCAGGC | 13 | 96 |
| 910962 | 2116 | 2131 | 14526 | 14541 | GTGAATTCTAACAGGC | 25 | 97 |
| 910966 | 2217 | 2232 | 14627 | 14642 | GGGTATTTTTGGCAAG | 46 | 98 |
| 910970 | 2360 | 2375 | N/A | N/A | AGCTCGGCTGCAGTTT | 41 | 99 |
| 910974 | 434 | 449 | 7499 | 7514 | GCCCAGCCGTGCCCCG | 64 | 100 |
| 910978 | 69 | 84 | 469 | 484 | CGAGAAGAAAAACCAC | 30 | 101 |
| 910982 | 1464 | 1479 | 13874 | 13889 | GGCCAGGTGTAGGGTT | 75 | 102 |
| 910986 | 1310 | 1325 | 13540 | 13555 | GGCAGGATGGTTTCTG | 99 | 103 |
| 910990 | 500 | 515 | 7663 | 7678 | CACCGTTGAGAGCTGG | 39 | 104 |
| 910994 | 768 | 783 | 8414 | 8429 | AGACACCATTTGCCAG | 62 | 105 |
| 910997 | 148 | 163 | 548 | 563 | GGTGAAGTGGACTGAC | 25 | 106 |
| 911001 | 1400 | 1415 | 13810 | 13825 | ATCCACGGTCCACACA | 96 | 107 |
| 911005 | 1219 | 1234 | N/A | N/A | GCCCAGCGGATGAGCG | 33* | 108 |
| 911009 | 1657 | 1672 | 14067 | 14082 | GCAAAGGATATGATGG | 59 | 109 |
| 911013 | 2277 | 2292 | N/A | N/A | AGCTGAGGCATGGATC | 62 | 110 |
| 911017 | 1739 | 1754 | 14149 | 14164 | CTGCAGGGCTCGACTG | 50 | 111 |
| 911021 | 902 | 917 | 9492 | 9507 | CTCCAGAGACTGTACC | 82 | 112 |
| 911025 | 38 | 53 | 438 | 453 | AGCCGCAGACCTCTCT | 39 | 113 |
| 911029 | 65 | 80 | 465 | 480 | AAGAAAAACCACGCTG | 70 | 114 |
| 911033 | 2111 | 2126 | 14521 | 14536 | TTCTAACAGGCCGTGT | 57 | 115 |
| 911037 | 818 | 833 | 8464 | 8479 | GAGGAAGTCCTCTGGC | 43 | 116 |
| 911041 | 875 | 890 | 9465 | 9480 | GAGGAGACATTGTGCC | 43 | 117 |
| 911045 | 879 | 894 | 9469 | 9484 | TCTGGAGGAGACATTG | 62 | 118 |
| 911049 | 327 | 342 | 6865 | 6880 | CTCGAAGATCTCGGCC | 69 | 119 |
| 911053 | 64 | 79 | 464 | 479 | AGAAAAACCACGCTGT | 46 | 120 |
| 911057 | 2109 | 2124 | 14519 | 14534 | CTAACAGGCCGTGTGT | 49 | 121 |
| 911061 | 1850 | 1865 | 14260 | 14275 | GGGACAGGATTGTGAC | 53 | 122 |

TABLE 2-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911065 | 1598 | 1613 | 14008 | 14023 | CAAGACAGTGGAAACC | 45 | 123 |
| 911069 | N/A | N/A | 13585 | 13600 | GGCCATCCCAGTCACC | 72 | 124 |
| 911073 | N/A | N/A | 13670 | 13685 | ACCAACAACCCACATC | 107 | 125 |
| 911077 | N/A | N/A | 13663 | 13678 | ACCCACATCCCGTTCC | 55 | 126 |
| 911081 | N/A | N/A | 745 | 760 | ATTAAGTACTTCACCT | 75 | 127 |
| 911085 | N/A | N/A | 1447 | 1462 | ATATGGACTCTGGTCA | 34 | 128 |
| 911089 | N/A | N/A | 1828 | 1843 | AAAAATGCACGCCCCC | 62 | 129 |
| 911093 | N/A | N/A | 2163 | 2178 | GCTATATATGTAATGG | 16 | 130 |
| 911097 | N/A | N/A | 2522 | 2537 | ATAACCATTGCAGTAC | 33 | 131 |
| 911101 | N/A | N/A | 2734 | 2749 | GTGAATAGTCAGTCCA | 21 | 132 |
| 911105 | N/A | N/A | 3246 | 3261 | TCATTAGGTGTCTGCA | 17 | 133 |
| 911109 | N/A | N/A | 3711 | 3726 | CAATCAAGGTTTTCGG | 35 | 134 |
| 911113 | N/A | N/A | 4083 | 4098 | TAGATTTAAAGGATCC | 45 | 135 |
| 911117 | N/A | N/A | 4442 | 4457 | CCAGATTTTTCCGCCA | 48 | 136 |
| 911121 | N/A | N/A | 5275 | 5290 | AGTATAGAAGGGTTCT | 38 | 137 |
| 911125 | N/A | N/A | 5819 | 5834 | CAGCATGGCAAGTGAC | 66 | 138 |
| 911129 | N/A | N/A | 6042 | 6057 | AGTGACATGGGTTTTA | 34 | 139 |
| 911133 | N/A | N/A | 6197 | 6212 | GCTATTGTAACAGTCC | 20 | 140 |
| 911137 | N/A | N/A | 6497 | 6512 | GTACATGTACATACCC | 59 | 141 |
| 911141 | N/A | N/A | 6992 | 7007 | ACAGTAAAGGTCGGCA | 49 | 142 |
| 911145 | N/A | N/A | 7422 | 7437 | GGCCATCCTGATCCTC | 59 | 143 |
| 911149 | N/A | N/A | 7866 | 7881 | GCCTACACTGCTCACA | 44 | 144 |
| 911153 | N/A | N/A | 8186 | 8201 | CACCTATGGAGGCTGT | 86 | 145 |
| 911157 | N/A | N/A | 8565 | 8580 | CTTACTACTTATTGGG | 78 | 146 |
| 911161 | N/A | N/A | 8687 | 8702 | TCTTATTATACATACG | 61 | 147 |
| 911165 | N/A | N/A | 8859 | 8874 | TGGCATGAGGAGTAGC | 57 | 148 |
| 911169 | N/A | N/A | 9506 | 9521 | GGCATTACCTGCTGCT | 78 | 149 |
| 911173 | N/A | N/A | 9604 | 9619 | CCTTTATACCAGCCCT | 59 | 150 |
| 911177 | N/A | N/A | 9921 | 9936 | GGGCATGTTTGGAGCT | 58 | 151 |
| 911181 | N/A | N/A | 10330 | 10345 | GGCTATTTGCATTTGC | 28 | 152 |
| 911185 | N/A | N/A | 10551 | 10566 | ATCTGTACATTCGCAT | 28 | 153 |
| 911189 | N/A | N/A | 10691 | 10706 | CGTATTTATTAGAGCA | 41 | 154 |
| 911193 | N/A | N/A | 11446 | 11461 | GCGGATGCATTTTCCC | 32 | 155 |
| 911197 | N/A | N/A | 11617 | 11632 | TGGAATTACTTAGCAG | 47 | 156 |
| 911201 | N/A | N/A | 11826 | 11841 | GCCAAAATAGTTCTCC | 42 | 157 |
| 911205 | N/A | N/A | 11909 | 11924 | GTCAACACCCGTGTCC | 57 | 158 |

TABLE 2-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911209 | N/A | N/A | 12243 | 12258 | TCACATTTGAGGCACG | 38 | 159 |
| 911213 | N/A | N/A | 12295 | 12310 | TGGTTTAGGTTTGGAT | 68 | 160 |
| 911217 | N/A | N/A | 12406 | 12421 | TAGCTTTAGGCTATTT | 72 | 161 |
| 911221 | N/A | N/A | 12771 | 12786 | GATGATTGCAGTGAGG | 40 | 162 |
| 911225 | N/A | N/A | 12820 | 12835 | GGGAATTTGATCAGTT | 79 | 163 |
| 911229 | N/A | N/A | 12928 | 12943 | GTTTGAATTATCGAGT | 59 | 164 |

TABLE 3

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910923 | 12 | 27 | 412 | 427 | TCCAAATTTTTTTCGA | 52 | 165 |
| 910927 | 178 | 193 | 6716 | 6731 | GGCATCGGGTCCTTGT | 51 | 166 |
| 910931 | 507 | 522 | 7670 | 7685 | GGGCATCCACCGTTGA | 57 | 167 |
| 910935 | 709 | 724 | 8286 | 8301 | TTCCTGGGTGCACTGG | 56 | 168 |
| 910939 | 944 | 959 | 9739 | 9754 | CTGCATGGCACTCAGC | 33 | 169 |
| 910943 | 1024 | 1039 | 11180 | 11195 | GCTACGATGCAGCAGG | 29 | 170 |
| 910947 | 1260 | 1275 | 13490 | 13505 | TCTCATTGAGTGTCCG | 27* | 171 |
| 910951 | 1552 | 1567 | 13962 | 13977 | GGCCTATCATCCCTGC | 96 | 172 |
| 910955 | 1799 | 1814 | 14209 | 14224 | GTAATCTGTGCGAGCA | 19 | 173 |
| 910959 | 1922 | 1937 | 14332 | 14347 | GATGATGCAGCTTTGA | 19 | 174 |
| 910963 | 2117 | 2132 | 14527 | 14542 | GGTGAATTCTAACAGG | 26 | 175 |
| 910967 | 2303 | 2318 | N/A | N/A | TAAATGAGTAGTTCCT | 37 | 176 |
| 910971 | 992 | 1007 | N/A | N/A | TGCCACAGATGAAGCC | 63 | 177 |
| 910975 | 72 | 87 | 472 | 487 | TACCGAGAAGAAAAAC | 56 | 178 |
| 910979 | 1855 | 1870 | 14265 | 14280 | AGTGAGGGACAGGATT | 36 | 179 |
| 910983 | 2072 | 2087 | 14482 | 14497 | CCTCAGATCCTGAGGG | 81 | 180 |
| 910987 | 421 | 436 | 7486 | 7501 | CCGGAGGGTGCCACCA | 52 | 181 |
| 910991 | 1092 | 1107 | 11248 | 11263 | CAAACAGGCTGTCAGG | 65 | 182 |
| 910995 | 78 | 93 | 478 | 493 | CTTTTATACCGAGAAG | 38 | 183 |
| 910998 | 1374 | 1389 | 13784 | 13799 | CGCTCTCCACCCGCAC | 41 | 184 |
| 911002 | 42 | 57 | 442 | 457 | TGGAAGCCGCAGACCT | 28 | 185 |
| 911006 | 2287 | 2302 | N/A | N/A | CTGCAGTCTAAGCTGA | 63 | 186 |
| 911010 | 423 | 438 | 7488 | 7503 | CCCCGGAGGGTGCCAC | 62 | 187 |
| 911014 | 1892 | 1907 | 14302 | 14317 | ACTGAGGCAGGCTCTC | 16 | 188 |

TABLE 3-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911018 | 1458 | 1473 | 13868 | 13883 | GTGTAGGGTTGGAACA | 84 | 189 |
| 911022 | 599 | 614 | 7762 | 7777 | GGAGAAGACCCCAGTG | 55 | 190 |
| 911026 | 66 | 81 | 466 | 481 | GAAGAAAACCACGCT | 56 | 191 |
| 911030 | 2355 | 2370 | N/A | N/A | GGCTGCAGTTTATTGG | 36 | 192 |
| 911034 | 132 | 147 | 532 | 547 | AGAAAAGGATCAGCCT | 65 | 193 |
| 911038 | 1459 | 1474 | 13869 | 13884 | GGTGTAGGGTTGGAAC | 70 | 194 |
| 911042 | 59 | 74 | 459 | 474 | AACCACGCTGTACGGT | 44 | 195 |
| 911046 | 131 | 146 | 531 | 546 | GAAAAGGATCAGCCTG | 52 | 196 |
| 911050 | 326 | 341 | 6864 | 6879 | TCGAAGATCTCGGCCC | 94 | 197 |
| 911054 | 1517 | 1532 | 13927 | 13942 | CACCAGTTTGGCCCCT | 39 | 198 |
| 911058 | 52 | 67 | 452 | 467 | CTGTACGGTGTGGAAG | 51 | 199 |
| 911062 | 76 | 91 | 476 | 491 | TTTATACCGAGAAGAA | 38 | 200 |
| 911070 | N/A | N/A | 13594 | 13609 | GGCACTTGAGGCCATC | 74 | 201 |
| 911074 | N/A | N/A | 13661 | 13676 | CCACATCCCGTTCCTC | 62 | 202 |
| 911078 | N/A | N/A | 13570 | 13585 | CGCCACCTCAGAGGAG | 104 | 203 |
| 911082 | N/A | N/A | 1258 | 1273 | AACTGATGCTCACTCT | 66 | 204 |
| 911086 | N/A | N/A | 1495 | 1510 | TGCAGAATCGAGCTCA | 27 | 205 |
| 911090 | N/A | N/A | 1923 | 1938 | CATAATAATACTCACC | 63 | 206 |
| 911094 | N/A | N/A | 2189 | 2204 | CAAATGATGAATTGGG | 23 | 207 |
| 911098 | N/A | N/A | 2610 | 2625 | GGGTTTATTGTGTGTC | 13 | 208 |
| 911102 | N/A | N/A | 2766 | 2781 | TGAGATAATTAGGGAG | 25 | 209 |
| 911106 | N/A | N/A | 3269 | 3284 | CCCTTCTACGCTGTCT | 39 | 210 |
| 911110 | N/A | N/A | 3753 | 3768 | GCCAATACAGAGCCCA | 9 | 211 |
| 911114 | N/A | N/A | 4155 | 4170 | ACAGATACTGGGACCC | 34 | 212 |
| 911118 | N/A | N/A | 4660 | 4675 | GCATAGATACATTCTC | 15 | 213 |
| 911122 | N/A | N/A | 5541 | 5556 | GGCTTTTCAGGATCCT | 57 | 214 |
| 911126 | N/A | N/A | 5937 | 5952 | TAGACATGAAGAGTCT | 69 | 215 |
| 911130 | N/A | N/A | 6108 | 6123 | TTAATCTGAAGCTGGA | 64 | 216 |
| 911134 | N/A | N/A | 6271 | 6286 | TCCTATTTTGCCCCAG | 48 | 217 |
| 911138 | N/A | N/A | 6498 | 6513 | GGTACATGTACATACC | 59 | 218 |
| 911142 | N/A | N/A | 7068 | 7083 | TGCATAAGTCACAGAC | 45 | 219 |
| 911146 | N/A | N/A | 7561 | 7576 | GTCCATACCTGGTGCA | 51 | 220 |
| 911150 | N/A | N/A | 7886 | 7901 | GAGTACTGCAATTCAG | 45 | 221 |
| 911154 | N/A | N/A | 8495 | 8510 | GTAGACTGGCACAGGC | 72 | 222 |
| 911158 | N/A | N/A | 8581 | 8596 | AGTTTAGCTCTTGCAT | 36 | 223 |
| 911162 | N/A | N/A | 8710 | 8725 | GGGTAAATAACAGCAC | 17 | 224 |

TABLE 3-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911166 | N/A | N/A | 9385 | 9400 | GGTGACCACGACAGGC | 62 | 225 |
| 911170 | N/A | N/A | 9538 | 9553 | CACTATCCCTATCCCT | 50 | 226 |
| 911174 | N/A | N/A | 9646 | 9661 | CCAGGCTACGGTCTTC | 64 | 227 |
| 911178 | N/A | N/A | 10311 | 10326 | AACAACTCAGGATCAC | 28 | 228 |
| 911182 | N/A | N/A | 10378 | 10393 | GGTTACATAGCTGGTC | 19 | 229 |
| 911186 | N/A | N/A | 10625 | 10640 | TTGAATAGGGCTCTTT | 51 | 230 |
| 911190 | N/A | N/A | 10692 | 10707 | CCGTATTTATTAGAGC | 49 | 231 |
| 911194 | N/A | N/A | 11447 | 11462 | AGCGGATGCATTTTCC | 21 | 232 |
| 911198 | N/A | N/A | 11683 | 11698 | TGGATAGGTGAGCTCG | 34 | 233 |
| 911202 | N/A | N/A | 11846 | 11861 | TTATTCTTTGCACCAC | 33 | 234 |
| 911206 | N/A | N/A | 11921 | 11936 | TGAGATCTCACCGTCA | 83 | 235 |
| 911210 | N/A | N/A | 12245 | 12260 | GGTCACATTTGAGGCA | 49 | 236 |
| 911214 | N/A | N/A | 12303 | 12318 | CTGGATGGTGGTTTAG | 82 | 237 |
| 911218 | N/A | N/A | 12528 | 12543 | GTATTGACATACTGGG | 35 | 238 |
| 911222 | N/A | N/A | 12777 | 12792 | AGCGATGATGATTGCA | 64 | 239 |
| 911226 | N/A | N/A | 12821 | 12836 | AGGGAATTTGATCAGT | 43 | 240 |
| 911230 | N/A | N/A | 13042 | 13057 | CCAACTTAAGGGTCAG | 42 | 241 |

TABLE 4

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910924 | 54 | 69 | 454 | 469 | CGCTGTACGGTGTGGA | 13 | 242 |
| 910928 | 269 | 284 | 6807 | 6822 | GGCTTTGGGTGCAGCC | 96 | 243 |
| 910932 | 560 | 575 | 7723 | 7738 | GATCATGGCTGGGCTC | 28 | 244 |
| 910936 | 749 | 764 | 8395 | 8410 | TGGGTAGGAGCTCTGG | 27 | 245 |
| 910940 | 946 | 961 | 9741 | 9756 | GCCTGCATGGCACTCA | 43 | 246 |
| 910944 | 1028 | 1043 | 11184 | 11199 | AGCAGCTACGATGCAG | 53 | 247 |
| 910948 | 1309 | 1324 | 13539 | 13554 | GCAGGATGGTTTCTGA | 99 | 248 |
| 910952 | 1562 | 1577 | 13972 | 13987 | GCACATCCAGGGCCTA | 25 | 249 |
| 910956 | 1800 | 1815 | 14210 | 14225 | AGTAATCTGTGCGAGC | 10 | 250 |
| 910960 | 2113 | 2128 | 14523 | 14538 | AATTCTAACAGGCCGT | 25 | 251 |
| 910964 | 2180 | 2195 | 14590 | 14605 | GTCTGCACGGGACTCA | 33 | 252 |
| 910968 | 2304 | 2319 | N/A | N/A | ATAAATGAGTAGTTCC | 28 | 253 |

TABLE 4-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910972 | 324 | 339 | 6862 | 6877 | GAAGATCTCGGCCCTG | 47 | 254 |
| 910976 | 2301 | 2316 | N/A | N/A | AATGAGTAGTTCCTCT | 35 | 255 |
| 910980 | 71 | 86 | 471 | 486 | ACCGAGAAGAAAAACC | 18 | 256 |
| 910984 | 385 | 400 | N/A | N/A | AGCTGCAGCTGCGATG | 44 | 257 |
| 910988 | 75 | 90 | 475 | 490 | TTATACCGAGAAGAAA | 68 | 258 |
| 910992 | 1893 | 1908 | 14303 | 14318 | TACTGAGGCAGGCTCT | 27 | 259 |
| 910996 | 36 | 51 | 436 | 451 | CCGCAGACCTCTCTCT | 36 | 260 |
| 910999 | 2302 | 2317 | N/A | N/A | AAATGAGTAGTTCCTC | 50 | 261 |
| 911003 | 413 | 428 | 7478 | 7493 | TGCCACCATGACTAGG | 62 | 262 |
| 911007 | 985 | 1000 | 9780 | 9795 | GATGAAGCCTTGGTCA | 50 | 263 |
| 911011 | 1901 | 1916 | 14311 | 14326 | TTTGAGTGTACTGAGG | 12 | 264 |
| 911015 | 1849 | 1864 | 14259 | 14274 | GGACAGGATTGTGACA | 56 | 265 |
| 911019 | 1792 | 1807 | 14202 | 14217 | GTGCGAGCAGCTGAGG | 13 | 266 |
| 911023 | 79 | 94 | 479 | 494 | GCTTTTATACCGAGAA | 5 | 267 |
| 911027 | 725 | 740 | N/A | N/A | CGAAAGGGTGCTGTCC | 78 | 268 |
| 911031 | 727 | 742 | N/A | N/A | GCCGAAAGGGTGCTGT | 48 | 269 |
| 911035 | 147 | 162 | 547 | 562 | GTGAAGTGGACTGACA | 43 | 270 |
| 911039 | 62 | 77 | 462 | 477 | AAAACCACGCTGTAC | 61 | 271 |
| 911043 | 2280 | 2295 | N/A | N/A | CTAAGCTGAGGCATGG | 35 | 272 |
| 911047 | 659 | 674 | 8236 | 8251 | GGACACCCATTCCAGG | 59 | 273 |
| 911051 | 116 | 131 | 516 | 531 | GGCTTGTGGGAAACTG | 17 | 274 |
| 911055 | 158 | 173 | N/A | N/A | GGGCAGGCTTGGTGAA | 82 | 275 |
| 911059 | 43 | 58 | 443 | 458 | GTGGAAGCCGCAGACC | 23 | 276 |
| 911063 | 1169 | 1184 | 12039 | 12054 | CTTGAAGTAGTCCATG | 49* | 277 |
| 911067 | N/A | N/A | 8302 | 8317 | GTCCACTGACCTGTCC | 111 | 278 |
| 911071 | N/A | N/A | 13600 | 13615 | TGCGATGGCACTTGAG | 51 | 279 |
| 911075 | N/A | N/A | 13564 | 13579 | CTCAGAGGAGCTCACC | 87 | 280 |
| 911079 | N/A | N/A | 13595 | 13610 | TGGCACTTGAGGCCAT | 119 | 281 |
| 911083 | N/A | N/A | 1275 | 1290 | GCTACTAGGGTGAACA | 22 | 282 |
| 911087 | N/A | N/A | 1547 | 1562 | AATAGCTAACACTTCG | 32 | 283 |
| 911091 | N/A | N/A | 2068 | 2083 | GGAGTAAGGACATGAC | 27 | 284 |
| 911095 | N/A | N/A | 2233 | 2248 | ATCATAAGCATCACAA | 49 | 285 |
| 911099 | N/A | N/A | 2639 | 2654 | TATAAGTTTTAACACC | 62 | 286 |
| 911103 | N/A | N/A | 2941 | 2956 | TGTATTGCAAAGCAAC | 38 | 287 |
| 911107 | N/A | N/A | 3357 | 3372 | GCATTTCGGTGAGGCC | 39 | 288 |
| 911111 | N/A | N/A | 3802 | 3817 | TGCCTTTGGTCTGGGC | 56 | 289 |

TABLE 4-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911115 | N/A | N/A | 4248 | 4263 | CACTATGACAAGCCCC | 29 | 290 |
| 911119 | N/A | N/A | 4945 | 4960 | TCCCTTATGGCCCCCA | 25 | 291 |
| 911123 | N/A | N/A | 5629 | 5644 | TTCTATTGTCCTCACC | 68 | 292 |
| 911127 | N/A | N/A | 5938 | 5953 | ATAGACATGAAGAGTC | 50 | 293 |
| 911131 | N/A | N/A | 6109 | 6124 | CTTAATCTGAAGCTGG | 22 | 294 |
| 911135 | N/A | N/A | 6309 | 6324 | CATCTTGCCGGAGCTG | 26 | 295 |
| 911139 | N/A | N/A | 6564 | 6579 | CCCATAGTTGCACCCC | 44 | 296 |
| 911143 | N/A | N/A | 7174 | 7189 | ACTACAATACGGCCTC | 44 | 297 |
| 911147 | N/A | N/A | 7572 | 7587 | GCCCATTCACCGTCCA | 48 | 298 |
| 911151 | N/A | N/A | 7963 | 7978 | TCTTTAAGGTTCTGCA | 40 | 299 |
| 911155 | N/A | N/A | 8496 | 8511 | GGTAGACTGGCACAGG | 33 | 300 |
| 911159 | N/A | N/A | 8684 | 8699 | TATTATACATACGAGA | 81 | 301 |
| 911163 | N/A | N/A | 8767 | 8782 | AGATTTTGATCAAGAC | 25 | 302 |
| 911167 | N/A | N/A | 9399 | 9414 | GAAGATTCCATGCAGG | 75 | 303 |
| 911171 | N/A | N/A | 9540 | 9555 | CGCACTATCCCTATCC | 12 | 304 |
| 911175 | N/A | N/A | 9868 | 9883 | AGGTTAGGTTCCCTGC | 34 | 305 |
| 911179 | N/A | N/A | 10316 | 10331 | GCTTTAACAACTCAGG | 10 | 306 |
| 911183 | N/A | N/A | 10451 | 10466 | GGTTATGTGGCACCCT | 21 | 307 |
| 911187 | N/A | N/A | 10686 | 10701 | TTATTAGAGCACAGGT | 72 | 308 |
| 911191 | N/A | N/A | 10716 | 10731 | TGGAATCCCACAAAAC | 61 | 309 |
| 911195 | N/A | N/A | 11611 | 11626 | TACTTAGCAGGGTCCC | 37 | 310 |
| 911199 | N/A | N/A | 11684 | 11699 | GTGGATAGGTGAGCTC | 29 | 311 |
| 911203 | N/A | N/A | 11864 | 11879 | TGACATAAGTTGTATC | 46 | 312 |
| 911207 | N/A | N/A | 11994 | 12009 | ATGAATCAAGCCCCAT | 95 | 313 |
| 911211 | N/A | N/A | 12284 | 12299 | TGGATTTGCGGACAGG | 33 | 314 |
| 911215 | N/A | N/A | 12324 | 12339 | CAGAATTTGGCATGCT | 51 | 315 |
| 911219 | N/A | N/A | 12530 | 12545 | GTGTATTGACATACTG | 67 | 316 |
| 911223 | N/A | N/A | 12790 | 12805 | GGATTACAGAGTCAGC | 36 | 317 |
| 911227 | N/A | N/A | 12893 | 12908 | TGGTTAGGTGGTTAGG | 59 | 318 |
| 911231 | N/A | N/A | 13242 | 13257 | GGGTATGGTTGTTCTG | 38 | 319 |

TABLE 5

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 32 | 65 |
| 1062005 | 1 | 16 | 401 | 416 | TTCGATGAGTGTGTGC | 43 | 320 |
| 1062037 | 118 | 133 | 518 | 533 | CTGGCTTGTGGGAAAC | 30 | 321 |
| 1062069 | 310 | 325 | 6848 | 6863 | TGGAAGGTTCCCCCTG | 110 | 322 |
| 1062101 | 422 | 437 | 7487 | 7502 | CCCGGAGGGTGCCACC | 212 | 323 |
| 1062133 | 594 | 609 | 7757 | 7772 | AGACCCCAGTGGCGGT | 69 | 324 |
| 1062165 | 752 | 767 | 8398 | 8413 | CAGTGGGTAGGAGCTC | 150 | 325 |
| 1062197 | 869 | 884 | 9459 | 9474 | ACATTGTGCCCTGCCC | 24 | 326 |
| 1062229 | 1049 | 1064 | 11205 | 11220 | GACGACAGGGCCTTGG | 53 | 327 |
| 1062261 | 1181 | 1196 | 12051 | 12066 | CATGTTGTGGAACTTG | 65* | 328 |
| 1062293 | 1423 | 1438 | 13833 | 13848 | CGTTTCTTGCGGAACT | 105 | 329 |
| 1062325 | 1592 | 1607 | 14002 | 14017 | AGTGGAAACCTCACTT | 86 | 330 |
| 1062357 | 1848 | 1863 | 14258 | 14273 | GACAGGATTGTGACAT | 43 | 331 |
| 1062389 | 2026 | 2041 | 14436 | 14451 | GCACACCCTGTGTTG | 61 | 332 |
| 1062421 | 2208 | 2223 | 14618 | 14633 | TGGCAAGGCAGTGTGT | 68 | 333 |
| 1062453 | N/A | N/A | 8298 | 8313 | ACTGACCTGTCCTTCC | 318 | 334 |
| 1062485 | N/A | N/A | 13599 | 13614 | GCGATGGCACTTGAGG | 143 | 335 |
| 1062549 | N/A | N/A | 684 | 699 | TACCTGGCTGGAATCA | 64 | 336 |
| 1062581 | N/A | N/A | 866 | 881 | ACAGCATTTCAAGTTG | 113 | 337 |
| 1062613 | N/A | N/A | 1108 | 1123 | GATCGATGGAGTGTGG | 104 | 338 |
| 1062645 | N/A | N/A | 1237 | 1252 | AATGTAAAGGTCCTCG | 23 | 339 |
| 1062678 | N/A | N/A | 1337 | 1352 | AAAGCGATACAAGCAA | 30 | 340 |
| 1062710 | N/A | N/A | 1475 | 1490 | AGCCCTGAACAACCTG | 67 | 341 |
| 1062742 | N/A | N/A | 1721 | 1736 | CGGCACTTGGTCAAAT | 102 | 342 |
| 1062774 | N/A | N/A | 1877 | 1892 | ATAGGACAACCTTTTG | 40 | 343 |
| 1062806 | N/A | N/A | 2074 | 2089 | CTATTAGGAGTAAGGA | 172 | 344 |
| 1062838 | N/A | N/A | 2159 | 2174 | TATATGTAATGGCTGA | 11 | 345 |
| 1062870 | N/A | N/A | 2391 | 2406 | CCTCTATAGTAAATGG | 62 | 346 |
| 1062902 | N/A | N/A | 2585 | 2600 | GCTAAGTATTTACTGT | 68 | 347 |
| 1062934 | N/A | N/A | 2731 | 2746 | AATAGTCAGTCCATTA | 46 | 348 |
| 1062966 | N/A | N/A | 2866 | 2881 | GAAAGCTTGGACATGG | 34 | 349 |
| 1062998 | N/A | N/A | 3067 | 3082 | GCGAGAGGAGGATTGC | 65 | 350 |
| 1063030 | N/A | N/A | 3244 | 3259 | ATTAGGTGTCTGCAGG | 74 | 351 |
| 1063062 | N/A | N/A | 3389 | 3404 | GAGATCTAGGCTTGGA | 21 | 352 |
| 1063094 | N/A | N/A | 3641 | 3656 | ATCACCACGCTCTGGC | 31 | 353 |
| 1063126 | N/A | N/A | 3863 | 3878 | CCAAATACATGGCCAC | 133 | 354 |

TABLE 5-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063158 | N/A | N/A | 4102 | 4117 | ATCATAGAACAGCATT | 19 | 355 |
| 1063190 | N/A | N/A | 4223 | 4238 | AGACCTGGCCCTTCTT | 122 | 356 |
| 1063222 | N/A | N/A | 4402 | 4417 | CCGGGCTTCATCGACA | 99 | 357 |
| 1063253 | N/A | N/A | 4555 | 4570 | TCCCTTTCTGACTGGG | 198 | 358 |
| 1063285 | N/A | N/A | 4710 | 4725 | AGAGCTAAGAATTCTC | 65 | 359 |
| 1063317 | N/A | N/A | 5080 | 5095 | CTGGGAGAGCACTGGT | 62 | 360 |
| 1063349 | N/A | N/A | 5274 | 5289 | GTATAGAAGGGTTCTG | 43 | 361 |
| 1063381 | N/A | N/A | 5482 | 5497 | CAGCCAACCCCATTAT | 134 | 362 |
| 1063413 | N/A | N/A | 5655 | 5670 | CTGTCCAAGCCACGCA | 96 | 363 |
| 1063445 | N/A | N/A | 5855 | 5870 | AGGAGGCGAGTCCAGG | 65 | 364 |
| 1063477 | N/A | N/A | 6012 | 6027 | AAGGACCGAGCTGACA | 39 | 365 |
| 1063509 | N/A | N/A | 6133 | 6148 | GCGAGAAGTGGGTAGA | 47 | 366 |
| 1063541 | N/A | N/A | 6280 | 6295 | TCCTCGGAGTCCTATT | 163 | 367 |
| 1063573 | N/A | N/A | 6449 | 6464 | GGCTTGCCTGCCCACG | 65 | 368 |
| 1063605 | N/A | N/A | 6969 | 6984 | GTCCAGGTACCCCACC | 100 | 369 |
| 1063637 | N/A | N/A | 7171 | 7186 | ACAATACGGCCTCCTC | 127 | 370 |
| 1063669 | N/A | N/A | 7376 | 7391 | ACTGCAAGCCCACATG | 84 | 371 |
| 1063701 | N/A | N/A | 7802 | 7817 | CTGAGGTGTTACCAGG | 35 | 372 |
| 1063733 | N/A | N/A | 7968 | 7983 | CTGCATCTTTAAGGTT | 60 | 373 |
| 1063765 | N/A | N/A | 8045 | 8060 | GCTTAAAGACGGCCAT | 88 | 374 |
| 1063796 | N/A | N/A | 8559 | 8574 | ACTTATTGGGATGAAG | 92 | 375 |
| 1063828 | N/A | N/A | 8848 | 8863 | GTAGCAGGGCAAAGCA | 69 | 376 |
| 1063860 | N/A | N/A | 9051 | 9066 | TAAGGGTTGTGTGTAG | 318 | 377 |
| 1063892 | N/A | N/A | 9413 | 9428 | TGCCTAAGTAGGGAGA | 78 | 378 |
| 1063924 | N/A | N/A | 9644 | 9659 | AGGCTACGGTCTTCCC | 68 | 379 |
| 1063956 | N/A | N/A | 9960 | 9975 | AGAGGGTTTGTAAGTA | 155 | 380 |
| 1063988 | N/A | N/A | 10527 | 10542 | ATAAATTACCACCAGC | 55 | 381 |
| 1064020 | N/A | N/A | 10757 | 10772 | TTTCAAAGCAAGGACG | 113 | 382 |
| 1064052 | N/A | N/A | 11379 | 11394 | ATGGAGCTCCTTTGCA | 219 | 383 |
| 1064084 | N/A | N/A | 11550 | 11565 | AGGCATGGCCCCAATC | 109 | 384 |
| 1064118 | N/A | N/A | 11622 | 11637 | GCTCCTGGAATTACTT | 38 | 385 |
| 1064150 | N/A | N/A | 11717 | 11732 | GCTAAGCCCACAGGCC | 215 | 386 |
| 1064182 | N/A | N/A | 11803 | 11818 | TGAAAAGAAGCGGAGT | 98 | 387 |
| 1064214 | N/A | N/A | 11910 | 11925 | CGTCAACACCCGTGTC | 93 | 388 |
| 1064246 | N/A | N/A | 11978 | 11993 | GCAGGACCTCCTAGCT | 203 | 389 |
| 1064278 | N/A | N/A | 12199 | 12214 | GGAATGGAGGAACCCA | 256 | 390 |

TABLE 5-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064310 | N/A | N/A | 12384 | 12399 | TCCAGGAGAGGGTTAG | 123 | 391 |
| 1064342 | N/A | N/A | 12578 | 12593 | ATCAAATGGGTGTTAC | 102 | 392 |
| 1064374 | N/A | N/A | 12781 | 12796 | AGTCAGCGATGATGAT | 64 | 393 |
| 1064406 | N/A | N/A | 12924 | 12939 | GAATTATCGAGTATCT | 57 | 394 |
| 1064438 | N/A | N/A | 13217 | 13232 | AAGGGATCAGGACTGA | 188 | 395 |

TABLE 6

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 60 | 65 |
| 1062006 | 2 | 17 | 402 | 417 | TTTCGATGAGTGTGTG | 38 | 396 |
| 1062038 | 119 | 134 | 519 | 534 | CCTGGCTTGTGGGAAA | 67 | 397 |
| 1062070 | 311 | 326 | 6849 | 6864 | CTGGAAGGTTCCCCCT | 109 | 398 |
| 1062102 | 424 | 439 | 7489 | 7504 | GCCCCGGAGGGTGCCA | 202 | 399 |
| 1062134 | 595 | 610 | 7758 | 7773 | AAGACCCCAGTGGCGG | 47 | 400 |
| 1062166 | 754 | 769 | 8400 | 8415 | AGCAGTGGGTAGGAGC | 77 | 401 |
| 1062198 | 876 | 891 | 9466 | 9481 | GGAGGAGACATTGTGC | 119 | 402 |
| 1062230 | 1050 | 1065 | 11206 | 11221 | GGACGACAGGGCCTTG | 164 | 403 |
| 1062262 | 1183 | 1198 | 12053 | 12068 | CGCATGTTGTGGAACT | 27* | 404 |
| 1062294 | 1426 | 1441 | 13836 | 13851 | CTCCGTTTCTTGCGGA | 136 | 405 |
| 1062326 | 1593 | 1608 | 14003 | 14018 | CAGTGGAAACCTCACT | 117 | 406 |
| 1062358 | 1852 | 1867 | 14262 | 14277 | GAGGGACAGGATTGTG | 134 | 407 |
| 1062390 | 2028 | 2043 | 14438 | 14453 | GGGCACACCCCTGTGT | 194 | 408 |
| 1062422 | 2209 | 2224 | 14619 | 14634 | TTGGCAAGGCAGTGTG | 20 | 409 |
| 1062454 | N/A | N/A | 8299 | 8314 | CACTGACCTGTCCTTC | 117 | 410 |
| 1062486 | N/A | N/A | 13601 | 13616 | CTGCGATGGCACTTGA | 115 | 411 |
| 1062550 | N/A | N/A | 685 | 700 | TTACCTGGCTGGAATC | 91 | 412 |
| 1062582 | N/A | N/A | 867 | 882 | GACAGCATTTCAAGTT | 139 | 413 |
| 1062614 | N/A | N/A | 1109 | 1124 | AGATCGATGGAGTGTG | 107 | 414 |
| 1062646 | N/A | N/A | 1238 | 1253 | AAATGTAAAGGTCCTC | 28 | 415 |
| 1062679 | N/A | N/A | 1338 | 1353 | TAAAGCGATACAAGCA | 100 | 416 |
| 1062711 | N/A | N/A | 1476 | 1491 | CAGCCCTGAACAACCT | 83 | 417 |
| 1062743 | N/A | N/A | 1723 | 1738 | ATCGGCACTTGGTCAA | 63 | 418 |
| 1062775 | N/A | N/A | 1878 | 1893 | AATAGGACAACCTTTT | 143 | 419 |

TABLE 6-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062807 | N/A | N/A | 2075 | 2090 | CCTATTAGGAGTAAGG | 140 | 420 |
| 1062839 | N/A | N/A | 2160 | 2175 | ATATATGTAATGGCTG | 31 | 421 |
| 1062871 | N/A | N/A | 2392 | 2407 | ACCTCTATAGTAAATG | 67 | 422 |
| 1062903 | N/A | N/A | 2609 | 2624 | GGTTTATTGTGTGTCA | 14 | 423 |
| 1062935 | N/A | N/A | 2732 | 2747 | GAATAGTCAGTCCATT | 54 | 424 |
| 1062967 | N/A | N/A | 2868 | 2883 | TAGAAAGCTTGGACAT | 156 | 425 |
| 1062999 | N/A | N/A | 3069 | 3084 | GTGCGAGAGGAGGATT | 111 | 426 |
| 1063031 | N/A | N/A | 3245 | 3260 | CATTAGGTGTCTGCAG | 37 | 427 |
| 1063063 | N/A | N/A | 3390 | 3405 | TGAGATCTAGGCTTGG | 41 | 428 |
| 1063095 | N/A | N/A | 3642 | 3657 | CATCACCACGCTCTGG | 110 | 429 |
| 1063127 | N/A | N/A | 3864 | 3879 | CCCAAATACATGGCCA | 77 | 430 |
| 1063159 | N/A | N/A | 4104 | 4119 | GAATCATAGAACAGCA | 20 | 431 |
| 1063191 | N/A | N/A | 4228 | 4243 | TCTGAAGACCTGGCCC | 90 | 432 |
| 1063223 | N/A | N/A | 4406 | 4421 | TGCGCCGGGCTTCATC | 87 | 433 |
| 1063254 | N/A | N/A | 4575 | 4590 | CTGCACTGTCTGTTGG | 176 | 434 |
| 1063286 | N/A | N/A | 4712 | 4727 | CCAGAGCTAAGAATTC | 81 | 435 |
| 1063318 | N/A | N/A | 5083 | 5098 | GGCCTGGGAGAGCACT | 153 | 436 |
| 1063350 | N/A | N/A | 5276 | 5291 | GAGTATAGAAGGGTTC | 68 | 437 |
| 1063382 | N/A | N/A | 5496 | 5511 | TGGAAGGGACTGCCCA | 145 | 438 |
| 1063414 | N/A | N/A | 5656 | 5671 | CCTGTCCAAGCCACGC | 19 | 439 |
| 1063446 | N/A | N/A | 5856 | 5871 | AAGGAGGCGAGTCCAG | 103 | 440 |
| 1063478 | N/A | N/A | 6013 | 6028 | GAAGGACCGAGCTGAC | 163 | 441 |
| 1063510 | N/A | N/A | 6135 | 6150 | AGGCGAGAAGTGGGTA | 53 | 442 |
| 1063542 | N/A | N/A | 6281 | 6296 | CTCCTCGGAGTCCTAT | 95 | 443 |
| 1063574 | N/A | N/A | 6455 | 6470 | GCACCTGGCTTGCCTG | 67 | 444 |
| 1063606 | N/A | N/A | 6981 | 6996 | CGGCACCTGTAGGTCC | 141 | 445 |
| 1063638 | N/A | N/A | 7172 | 7187 | TACAATACGGCCTCCT | 86 | 446 |
| 1063670 | N/A | N/A | 7377 | 7392 | CACTGCAAGCCCACAT | 66 | 447 |
| 1063702 | N/A | N/A | 7803 | 7818 | GCTGAGGTGTTACCAG | 109 | 448 |
| 1063734 | N/A | N/A | 7980 | 7995 | GATTTGACATTCTGC | 11 | 449 |
| 1063766 | N/A | N/A | 8046 | 8061 | AGCTTAAAGACGGCCA | 147 | 450 |
| 1063797 | N/A | N/A | 8560 | 8575 | TACTTATTGGGATGAA | 75 | 451 |
| 1063829 | N/A | N/A | 8850 | 8865 | GAGTAGCAGGGCAAAG | 183 | 452 |
| 1063861 | N/A | N/A | 9052 | 9067 | CTAAGGGTTGTGTGTA | 235 | 453 |
| 1063893 | N/A | N/A | 9414 | 9429 | GTGCCTAAGTAGGGAG | 105 | 454 |
| 1063925 | N/A | N/A | 9645 | 9660 | CAGGCTACGGTCTTCC | 62 | 455 |

TABLE 6-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063957 | N/A | N/A | 9961 | 9976 | CAGAGGGTTTGTAAGT | 102 | 456 |
| 1063989 | N/A | N/A | 10541 | 10556 | TCGCATCATGAGAAAT | 82 | 457 |
| 1064021 | N/A | N/A | 11113 | 11128 | GCTTAAACTTCCCACT | 106 | 458 |
| 1064053 | N/A | N/A | 11380 | 11395 | CATGGAGCTCCTTTGC | 182 | 459 |
| 1064085 | N/A | N/A | 11551 | 11566 | GAGGCATGGCCCCAAT | 211 | 460 |
| 1064119 | N/A | N/A | 11633 | 11648 | GGAAAGGAGGTGCTCC | 92 | 461 |
| 1064151 | N/A | N/A | 11719 | 11734 | CTGCTAAGCCCACAGG | 140 | 462 |
| 1064183 | N/A | N/A | 11804 | 11819 | TTGAAAAGAAGCGGAG | 141 | 463 |
| 1064215 | N/A | N/A | 11913 | 11928 | CACCGTCAACACCCGT | 63 | 464 |
| 1064247 | N/A | N/A | 11980 | 11995 | ATGCAGGACCTCCTAG | 244 | 465 |
| 1064279 | N/A | N/A | 12200 | 12215 | GGGAATGGAGGAACCC | 112 | 466 |
| 1064311 | N/A | N/A | 12385 | 12400 | GTCCAGGAGAGGGTTA | 241 | 467 |
| 1064343 | N/A | N/A | 12579 | 12594 | GATCAAATGGGTGTTA | 84 | 468 |
| 1064375 | N/A | N/A | 12784 | 12799 | CAGAGTCAGCGATGAT | 77 | 469 |
| 1064407 | N/A | N/A | 12925 | 12940 | TGAATTATCGAGTATC | 53 | 470 |
| 1064439 | N/A | N/A | 13219 | 13234 | GTAAGGGATCAGGACT | 136 | 471 |

TABLE 7

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 20 | 65 |
| 1062008 | 4 | 19 | 404 | 419 | TTTTTCGATGAGTGTG | 9 | 472 |
| 1062040 | 128 | 143 | 528 | 543 | AAGGATCAGCCTGGCT | 67 | 473 |
| 1062072 | 313 | 328 | 6851 | 6866 | CCCTGGAAGGTTCCCC | 49 | 474 |
| 1062104 | 459 | 474 | 7524 | 7539 | GGAGTGCCTGTAAGTG | 13 | 475 |
| 1062136 | 597 | 612 | 7760 | 7775 | AGAAGACCCCAGTGGC | 47 | 476 |
| 1062168 | 766 | 781 | 8412 | 8427 | ACACCATTTGCCAGCA | 59 | 477 |
| 1062200 | 878 | 893 | 9468 | 9483 | CTGGAGGAGACATTGT | 62 | 478 |
| 1062232 | 1091 | 1106 | 11247 | 11262 | AAACAGGCTGTCAGGG | 101 | 479 |
| 1062264 | 1185 | 1200 | 12055 | 12070 | GTCGCATGTTGTGGAA | 10* | 480 |
| 1062296 | 1430 | 1445 | 13840 | 13855 | CTGGCTCCGTTTCTTG | 130 | 481 |
| 1062328 | 1595 | 1610 | 14005 | 14020 | GACAGTGGAAACCTCA | 15 | 482 |
| 1062360 | 1854 | 1869 | 14264 | 14279 | GTGAGGGACAGGATTG | 58 | 483 |

TABLE 7-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062392 | 2040 | 2055 | 14450 | 14465 | GTGTAGGCCTCTGGGC | 45 | 484 |
| 1062424 | 2212 | 2227 | 14622 | 14637 | TTTTTGGCAAGGCAGT | 61 | 485 |
| 1062456 | N/A | N/A | 8301 | 8316 | TCCACTGACCTGTCCT | 73 | 486 |
| 1062488 | N/A | N/A | 13603 | 13618 | AGCTGCGATGGCACTT | 116 | 487 |
| 1062520 | N/A | N/A | 553 | 568 | ACCTTGGTGAAGTGGA | 63 | 488 |
| 1062552 | N/A | N/A | 687 | 702 | CCTTACCTGGCTGGAA | 187 | 489 |
| 1062584 | N/A | N/A | 879 | 894 | CAGTTGCACCTGGACA | 111 | 490 |
| 1062616 | N/A | N/A | 1111 | 1126 | GGAGATCGATGGAGTG | 37 | 491 |
| 1062648 | N/A | N/A | 1259 | 1274 | GAACTGATGCTCACTC | 26 | 492 |
| 1062681 | N/A | N/A | 1340 | 1355 | TCTAAAGCGATACAAG | 97 | 493 |
| 1062713 | N/A | N/A | 1490 | 1505 | AATCGAGCTCACCCCA | 76 | 494 |
| 1062745 | N/A | N/A | 1726 | 1741 | ACAATCGGCACTTGGT | 34 | 495 |
| 1062777 | N/A | N/A | 1886 | 1901 | GAGCATAAAATAGGAC | 57 | 496 |
| 1062809 | N/A | N/A | 2077 | 2092 | ACCCTATTAGGAGTAA | 144 | 497 |
| 1062841 | N/A | N/A | 2234 | 2249 | CATCATAAGCATCACA | 19 | 498 |
| 1062873 | N/A | N/A | 2396 | 2411 | CTTAACCTCTATAGTA | 51 | 499 |
| 1062905 | N/A | N/A | 2616 | 2631 | GATCTTGGGTTTATTG | 81 | 500 |
| 1062937 | N/A | N/A | 2735 | 2750 | AGTGAATAGTCAGTCC | 17 | 501 |
| 1062969 | N/A | N/A | 2905 | 2920 | CCTGGTATAAGAACAG | 23 | 502 |
| 1063001 | N/A | N/A | 3100 | 3115 | GGACACATGCATGGAG | 73 | 503 |
| 1063033 | N/A | N/A | 3248 | 3263 | AGTCATTAGGTGTCTG | 23 | 504 |
| 1063065 | N/A | N/A | 3392 | 3407 | CCTGAGATCTAGGCTT | 48 | 505 |
| 1063097 | N/A | N/A | 3658 | 3673 | ACTGACATGCCTCCAT | 54 | 506 |
| 1063129 | N/A | N/A | 3884 | 3899 | GTCCACTCTGGAACAA | 91 | 507 |
| 1063161 | N/A | N/A | 4123 | 4138 | GTATAACACCAGGACC | 63 | 508 |
| 1063193 | N/A | N/A | 4236 | 4251 | CCCCTAGCTCTGAAGA | 69 | 509 |
| 1063225 | N/A | N/A | 4414 | 4429 | CGGCCGGATGCGCCGG | 120 | 510 |
| 1063256 | N/A | N/A | 4584 | 4599 | GCCGGCTTCCTGCACT | 100 | 511 |
| 1063288 | N/A | N/A | 4714 | 4729 | GGCCAGAGCTAAGAAT | 71 | 512 |
| 1063320 | N/A | N/A | 5094 | 5109 | CTCCGAACAAGGGCCT | 30 | 513 |
| 1063352 | N/A | N/A | 5313 | 5328 | CTGAGTTGGGCACACA | 58 | 514 |
| 1063384 | N/A | N/A | 5521 | 5536 | TCCTGGTCTGAGAGGA | 76 | 515 |
| 1063416 | N/A | N/A | 5686 | 5701 | GCCTCAAATGCCCACT | 61 | 516 |
| 1063448 | N/A | N/A | 5858 | 5873 | GCAAGGAGGCGAGTCC | 55 | 517 |
| 1063480 | N/A | N/A | 6015 | 6030 | TGGAAGGACCGAGCTG | 101 | 518 |
| 1063512 | N/A | N/A | 6139 | 6154 | GAGAAGGCGAGAAGTG | 150 | 519 |

TABLE 7-continued

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063544 | N/A | N/A | 6293 | 6308 | GTCTCGGACTTTCTCC | 57 | 520 |
| 1063576 | N/A | N/A | 6483 | 6498 | CCACACATGCCCCACG | 102 | 521 |
| 1063608 | N/A | N/A | 6983 | 6998 | GTCGGCACCTGTAGGT | 50 | 522 |
| 1063640 | N/A | N/A | 7175 | 7190 | GACTACAATACGGCCT | 52 | 523 |
| 1063672 | N/A | N/A | 7382 | 7397 | CTCTGCACTGCAAGCC | 30 | 524 |
| 1063704 | N/A | N/A | 7867 | 7882 | AGCCTACACTGCTCAC | 60 | 525 |
| 1063736 | N/A | N/A | 8001 | 8016 | TGTAAAGCTCTGTGGT | 43 | 526 |
| 1063768 | N/A | N/A | 8048 | 8063 | GAAGCTTAAAGACGGC | 42 | 527 |
| 1063799 | N/A | N/A | 8563 | 8578 | TACTACTTATTGGGAT | 52 | 528 |
| 1063831 | N/A | N/A | 8852 | 8867 | AGGAGTAGCAGGGCAA | 60 | 529 |
| 1063863 | N/A | N/A | 9054 | 9069 | TGCTAAGGGTTGTGTG | 37 | 530 |
| 1063895 | N/A | N/A | 9425 | 9440 | TCCGCCTGGCAGTGCC | 40 | 531 |
| 1063927 | N/A | N/A | 9687 | 9702 | ACATGAGGCCTCAGCC | 91 | 532 |
| 1063959 | N/A | N/A | 9963 | 9978 | GTCAGAGGGTTTGTAA | 64 | 533 |
| 1063991 | N/A | N/A | 10543 | 10558 | ATTCGCATCATGAGAA | 33 | 534 |
| 1064023 | N/A | N/A | 11115 | 11130 | AGGCTTAAACTTCCCA | 60 | 535 |
| 1064055 | N/A | N/A | 11383 | 11398 | CAGCATGGAGCTCCTT | 27 | 536 |
| 1064087 | N/A | N/A | 11554 | 11569 | GGTGAGGCATGGCCCC | 57 | 537 |
| 1064121 | N/A | N/A | 11653 | 11668 | GATTTTCCTTGGTCAG | 119 | 538 |
| 1064153 | N/A | N/A | 11728 | 11743 | CTCTGATCCCTGCTAA | 84 | 539 |
| 1064185 | N/A | N/A | 11810 | 11825 | CCGAGGTTGAAAAGAA | 87 | 540 |
| 1064217 | N/A | N/A | 11919 | 11934 | AGATCTCACCGTCAAC | 107 | 541 |
| 1064249 | N/A | N/A | 11984 | 11999 | CCCCATGCAGGACCTC | 129 | 542 |
| 1064281 | N/A | N/A | 12202 | 12217 | TTGGGAATGGAGGAAC | 106 | 543 |
| 1064313 | N/A | N/A | 12396 | 12411 | CTATTTTATGGGTCCA | 14 | 544 |
| 1064345 | N/A | N/A | 12584 | 12599 | TTAAGGATCAAATGGG | 74 | 545 |
| 1064377 | N/A | N/A | 12786 | 12801 | TACAGAGTCAGCGATG | 60 | 546 |
| 1064409 | N/A | N/A | 12927 | 12942 | TTTGAATTATCGAGTA | 66 | 547 |
| 1064441 | N/A | N/A | 13221 | 13236 | AGGTAAGGGATCAGGA | 83 | 548 |

TABLE 8

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 24 | 65 |
| 1062009 | 5 | 20 | 405 | 420 | TTTTTTCGATGAGTGT | 29 | 549 |
| 1062041 | 143 | 158 | 543 | 558 | AGTGGACTGACAGAAA | 39 | 550 |
| 1062073 | 314 | 329 | 6852 | 6867 | GCCCTGGAAGGTTCCC | 114 | 551 |
| 1062105 | 461 | 476 | 7526 | 7541 | GAGGAGTGCCTGTAAG | 61 | 552 |
| 1062137 | 600 | 615 | 7763 | 7778 | GGGAGAAGACCCCAGT | 86 | 553 |
| 1062169 | 771 | 786 | 8417 | 8432 | TGCAGACACCATTTGC | 75 | 554 |
| 1062201 | 895 | 910 | 9485 | 9500 | GACTGTACCATCTCTC | 87 | 555 |
| 1062233 | 1098 | 1113 | 11254 | 11269 | GGACAGCAAACAGGCT | 87 | 556 |
| 1062265 | 1186 | 1201 | 12056 | 12071 | GGTCGCATGTTGTGGA | 10* | 557 |
| 1062297 | 1433 | 1448 | 13843 | 13858 | CCTCTGGCTCCGTTTC | 95 | 558 |
| 1062329 | 1596 | 1611 | 14006 | 14021 | AGACAGTGGAAACCTC | 85 | 559 |
| 1062361 | 1856 | 1871 | 14266 | 14281 | GAGTGAGGGACAGGAT | 16 | 560 |
| 1062393 | 2041 | 2056 | 14451 | 14466 | TGTGTAGGCCTCTGGG | 23 | 561 |
| 1062425 | 2215 | 2230 | 14625 | 14640 | GTATTTTTGGCAAGGC | 19 | 562 |
| 1062457 | N/A | N/A | 8304 | 8319 | CTGTCCACTGACCTGT | 39 | 563 |
| 1062489 | N/A | N/A | 13609 | 13624 | ACTTTGAGCTGCGATG | 64 | 564 |
| 1062521 | N/A | N/A | 554 | 569 | CACCTTGGTGAAGTGG | 70 | 565 |
| 1062553 | N/A | N/A | 688 | 703 | ACCTTACCTGGCTGGA | 58 | 566 |
| 1062585 | N/A | N/A | 880 | 895 | TCAGTTGCACCTGGAC | 48 | 567 |
| 1062617 | N/A | N/A | 1112 | 1127 | AGGAGATCGATGGAGT | 67 | 568 |
| 1062649 | N/A | N/A | 1260 | 1275 | AGAACTGATGCTCACT | 41 | 569 |
| 1062682 | N/A | N/A | 1341 | 1356 | CTCTAAAGCGATACAA | 94 | 570 |
| 1062714 | N/A | N/A | 1491 | 1506 | GAATCGAGCTCACCCC | 56 | 571 |
| 1062746 | N/A | N/A | 1727 | 1742 | AACAATCGGCACTTGG | 31 | 572 |
| 1062778 | N/A | N/A | 1887 | 1902 | GGAGCATAAAATAGGA | 116 | 573 |
| 1062810 | N/A | N/A | 2078 | 2093 | CACCCTATTAGGAGTA | 94 | 574 |
| 1062842 | N/A | N/A | 2235 | 2250 | CCATCATAAGCATCAC | 24 | 575 |
| 1062874 | N/A | N/A | 2397 | 2412 | TCTTAACCTCTATAGT | 46 | 576 |
| 1062906 | N/A | N/A | 2618 | 2633 | CTGATCTTGGGTTTAT | 63 | 577 |
| 1062938 | N/A | N/A | 2736 | 2751 | GAGTGAATAGTCAGTC | 10 | 578 |
| 1062970 | N/A | N/A | 2920 | 2935 | GCAAAACAGTGTGGCC | 65 | 579 |
| 1063002 | N/A | N/A | 3125 | 3140 | GATAGTGAGAGACATT | 98 | 580 |
| 1063034 | N/A | N/A | 3249 | 3264 | AAGTCATTAGGTGTCT | 28 | 581 |
| 1063066 | N/A | N/A | 3393 | 3408 | TCCTGAGATCTAGGCT | 83 | 582 |
| 1063098 | N/A | N/A | 3666 | 3681 | CCTGACTGACTGACAT | 113 | 583 |

TABLE 8-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063130 | N/A | N/A | 3886 | 3901 | CTGTCCACTCTGGAAC | 69 | 584 |
| 1063162 | N/A | N/A | 4124 | 4139 | AGTATAACACCAGGAC | 36 | 585 |
| 1063194 | N/A | N/A | 4243 | 4258 | TGACAAGCCCCTAGCT | 112 | 586 |
| 1063226 | N/A | N/A | 4418 | 4433 | ATGGCGGCCGGATGCG | 147 | 587 |
| 1063257 | N/A | N/A | 4586 | 4601 | CAGCCGGCTTCCTGCA | 122 | 588 |
| 1063289 | N/A | N/A | 4719 | 4734 | CACTTGGCCAGAGCTA | 29 | 589 |
| 1063321 | N/A | N/A | 5095 | 5110 | GCTCCGAACAAGGGCC | 59 | 590 |
| 1063353 | N/A | N/A | 5314 | 5329 | ACTGAGTTGGGCACAC | 63 | 591 |
| 1063385 | N/A | N/A | 5522 | 5537 | ATCCTGGTCTGAGAGG | 52 | 592 |
| 1063417 | N/A | N/A | 5727 | 5742 | CCAATTTCTGGCCCTC | 51 | 593 |
| 1063449 | N/A | N/A | 5859 | 5874 | GGCAAGGAGGCGAGTC | 29 | 594 |
| 1063481 | N/A | N/A | 6016 | 6031 | CTGGAAGGACCGAGCT | 80 | 595 |
| 1063513 | N/A | N/A | 6140 | 6155 | GGAGAAGGCGAGAAGT | 46 | 596 |
| 1063545 | N/A | N/A | 6303 | 6318 | GCCGGAGCTGGTCTCG | 85 | 597 |
| 1063577 | N/A | N/A | 6563 | 6578 | CCATAGTTGCACCCCA | 37 | 598 |
| 1063609 | N/A | N/A | 6985 | 7000 | AGGTCGGCACCTGTAG | 56 | 599 |
| 1063641 | N/A | N/A | 7176 | 7191 | GGACTACAATACGGCC | 47 | 600 |
| 1063673 | N/A | N/A | 7387 | 7402 | AAATACTCTGCACTGC | 101 | 601 |
| 1063705 | N/A | N/A | 7868 | 7883 | TAGCCTACACTGCTCA | 72 | 602 |
| 1063737 | N/A | N/A | 8006 | 8021 | AGCTTTGTAAAGCTCT | 30 | 603 |
| 1063769 | N/A | N/A | 8049 | 8064 | AGAAGCTTAAAGACGG | 68 | 604 |
| 1063800 | N/A | N/A | 8564 | 8579 | TTACTACTTATTGGGA | 124 | 605 |
| 1063832 | N/A | N/A | 8854 | 8869 | TGAGGAGTAGCAGGGC | 47 | 606 |
| 1063864 | N/A | N/A | 9055 | 9070 | CTGCTAAGGGTTGTGT | 88 | 607 |
| 1063896 | N/A | N/A | 9503 | 9518 | ATTACCTGCTGCTCCA | 72 | 608 |
| 1063928 | N/A | N/A | 9688 | 9703 | AACATGAGGCCTCAGC | 80 | 609 |
| 1063960 | N/A | N/A | 10283 | 10298 | TCTTAGAGTCAGAGGG | 30 | 610 |
| 1063992 | N/A | N/A | 10545 | 10560 | ACATTCGCATCATGAG | 60 | 611 |
| 1064024 | N/A | N/A | 11116 | 11131 | GAGGCTTAAACTTCCC | 34 | 612 |
| 1064056 | N/A | N/A | 11386 | 11401 | GGGCAGCATGGAGCTC | 83 | 613 |
| 1064088 | N/A | N/A | 11560 | 11575 | AGAGTGGGTGAGGCAT | 94 | 614 |
| 1064122 | N/A | N/A | 11654 | 11669 | CGATTTTCCTTGGTCA | 26 | 615 |
| 1064154 | N/A | N/A | 11729 | 11744 | TCTCTGATCCCTGCTA | 94 | 616 |
| 1064186 | N/A | N/A | 11811 | 11826 | CCCGAGGTTGAAAAGA | 63 | 617 |
| 1064218 | N/A | N/A | 11920 | 11935 | GAGATCTCACCGTCAA | 69 | 618 |
| 1064250 | N/A | N/A | 11987 | 12002 | AAGCCCCATGCAGGAC | 80 | 619 |

TABLE 8-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064282 | N/A | N/A | 12240 | 12255 | CATTTGAGGCACGGCT | 105 | 620 |
| 1064314 | N/A | N/A | 12399 | 12414 | AGGCTATTTTATGGGT | 70 | 621 |
| 1064346 | N/A | N/A | 12585 | 12600 | GTTAAGGATCAAATGG | 78 | 622 |
| 1064378 | N/A | N/A | 12787 | 12802 | TTACAGAGTCAGCGAT | 105 | 623 |
| 1064410 | N/A | N/A | 12936 | 12951 | CAGAGATGGTTTGAAT | 75 | 624 |
| 1064442 | N/A | N/A | 13222 | 13237 | TAGGTAAGGGATCAGG | 76 | 625 |

Example 2: Antisense Inhibition of Human Foxp3 in SUP-M2 Cells by cEt Gapmers

Modified oligonucleotides were designed to target a Foxp3 nucleic acid and were tested for their effect on Foxp3 mRNA level in vitro. The modified oligonucleotides were tested in a series of experiments that had similar culture conditions. The results for each experiment are presented in separate tables shown below. Cultured SUP-M2 cells at a density of 60,000 cells per well were treated using free uptake with 3,000 nM of modified oligonucleotide. After a treatment period of approximately 24 hours, RNA was isolated from the cells and Foxp3 mRNA levels were measured by quantitative real-time RTPCR. Human primer probe set RTS35925 was used to measure mRNA levels. Foxp3 mRNA levels were adjusted according to total RNA content, as measured by RIBOGREEN®. Results are presented in the tables below as percent control of the amount of Foxp3 mRNA relative to untreated control cells (% UTC). The modified oligonucleotides with percent control values marked with an asterisk (*) target the amplicon region of the primer probe set. Additional assays may be used to measure the potency and efficacy of the modified oligonucleotides targeting the amplicon region.

The newly designed modified oligonucleotides in the Tables below were designed as 3-10-3 cEt gapmers. The gapmers are 16 nucleosides in length, wherein the central gap segment comprises of ten 2'-deoxynucleosides and is flanked by wing segments on the 5' direction and the 3' direction comprising three nucleosides each. Each nucleoside in the 5' wing segment and each nucleoside in the 3' wing segment has a cEt sugar modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to either SEQ ID NO.: 1 or SEQ ID NO.: 2. 'N/A' indicates that the modified oligonucleotide does not target that particular gene sequence with 100% complementarity. 'N.D.' indicates that the % UTC is not defined for that specific modified oligonucleotide in that specific experiment. Activity of that modified oligonucleotide may be defined in a different experiment.

TABLE 9

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910956 | 1800 | 1815 | 14210 | 14225 | AGTAATCTGTGCGAGC | 21 | 250 |
| 911144 | N/A | N/A | 7355 | 7370 | TGCTATGATCATCCCC | 37 | 65 |
| 1062005 | 1 | 16 | 401 | 416 | TTCGATGAGTGTGTGC | 20 | 320 |
| 1062037 | 118 | 133 | 518 | 533 | CTGGCTTGTGGGAAAC | 63 | 321 |
| 1062069 | 310 | 325 | 6848 | 6863 | TGGAAGGTTCCCCCTG | 142 | 322 |
| 1062101 | 422 | 437 | 7487 | 7502 | CCCGGAGGGTGCCACC | 135 | 323 |
| 1062133 | 594 | 609 | 7757 | 7772 | AGACCCCAGTGGCGGT | 85 | 324 |
| 1062165 | 752 | 767 | 8398 | 8413 | CAGTGGGTAGGAGCTC | 66 | 325 |
| 1062197 | 869 | 884 | 9459 | 9474 | ACATTGTGCCCTGCCC | 101 | 326 |

TABLE 9-continued

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062229 | 1049 | 1064 | 11205 | 11220 | GACGACAGGGCCTTGG | 78 | 327 |
| 1062261 | 1181 | 1196 | 12051 | 12066 | CATGTTGTGGAACTTG | 111* | 328 |
| 1062293 | 1423 | 1438 | 13833 | 13848 | CGTTTCTTGCGGAACT | 105 | 329 |
| 1062325 | 1592 | 1607 | 14002 | 14017 | AGTGGAAACCTCACTT | 67 | 330 |
| 1062357 | 1848 | 1863 | 14258 | 14273 | GACAGGATTGTGACAT | 101 | 331 |
| 1062389 | 2026 | 2041 | 14436 | 14451 | GCACACCCTGTGTTG | 84 | 332 |
| 1062421 | 2208 | 2223 | 14618 | 14633 | TGGCAAGGCAGTGTGT | 66 | 333 |
| 1062453 | N/A | N/A | 8298 | 8313 | ACTGACCTGTCCTTCC | 133 | 334 |
| 1062485 | N/A | N/A | 13599 | 13614 | GCGATGGCACTTGAGG | 68 | 335 |
| 1062517 | N/A | N/A | N/A | N/A | GGCGAGGCTCCTGAGA | 92 | 626 |
| 1062549 | N/A | N/A | 684 | 699 | TACCTGGCTGGAATCA | 101 | 336 |
| 1062581 | N/A | N/A | 866 | 881 | ACAGCATTTCAAGTTG | 132 | 337 |
| 1062613 | N/A | N/A | 1108 | 1123 | GATCGATGGAGTGTGG | 65 | 338 |
| 1062645 | N/A | N/A | 1237 | 1252 | AATGTAAAGGTCCTCG | 27 | 339 |
| 1062678 | N/A | N/A | 1337 | 1352 | AAAGCGATACAAGCAA | 87 | 340 |
| 1062710 | N/A | N/A | 1475 | 1490 | AGCCCTGAACAACCTG | 85 | 341 |
| 1062742 | N/A | N/A | 1721 | 1736 | CGGCACTTGGTCAAAT | 96 | 342 |
| 1062774 | N/A | N/A | 1877 | 1892 | ATAGGACAACCTTTTG | 113 | 343 |
| 1062806 | N/A | N/A | 2074 | 2089 | CTATTAGGAGTAAGGA | 70 | 344 |
| 1062838 | N/A | N/A | 2159 | 2174 | TATATGTAATGGCTGA | 25 | 345 |
| 1062870 | N/A | N/A | 2391 | 2406 | CCTCTATAGTAAATGG | 108 | 346 |
| 1062902 | N/A | N/A | 2585 | 2600 | GCTAAGTATTTACTGT | 52 | 347 |
| 1062934 | N/A | N/A | 2731 | 2746 | AATAGTCAGTCCATTA | 78 | 348 |
| 1062966 | N/A | N/A | 2866 | 2881 | GAAAGCTTGGACATGG | 47 | 349 |
| 1062998 | N/A | N/A | 3067 | 3082 | GCGAGAGGAGGATTGC | 103 | 350 |
| 1063030 | N/A | N/A | 3244 | 3259 | ATTAGGTGTCTGCAGG | 45 | 351 |
| 1063062 | N/A | N/A | 3389 | 3404 | GAGATCTAGGCTTGGA | 26 | 352 |
| 1063094 | N/A | N/A | 3641 | 3656 | ATCACCACGCTCTGGC | 38 | 353 |
| 1063126 | N/A | N/A | 3863 | 3878 | CCAAATACATGGCCAC | 73 | 354 |
| 1063158 | N/A | N/A | 4102 | 4117 | ATCATAGAACAGCATT | 26 | 355 |
| 1063190 | N/A | N/A | 4223 | 4238 | AGACCTGGCCCTTCTT | 125 | 356 |
| 1063222 | N/A | N/A | 4402 | 4417 | CCGGGCTTCATCGACA | 108 | 357 |
| 1063253 | N/A | N/A | 4555 | 4570 | TCCCTTTCTGACTGGG | 108 | 358 |
| 1063285 | N/A | N/A | 4710 | 4725 | AGAGCTAAGAATTCTC | 108 | 359 |
| 1063317 | N/A | N/A | 5080 | 5095 | CTGGGAGAGCACTGGT | 111 | 360 |
| 1063349 | N/A | N/A | 5274 | 5289 | GTATAGAAGGGTTCTG | 64 | 361 |

TABLE 9-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063381 | N/A | N/A | 5482 | 5497 | CAGCCAACCCCATTAT | 139 | 362 |
| 1063413 | N/A | N/A | 5655 | 5670 | CTGTCCAAGCCACGCA | 79 | 363 |
| 1063445 | N/A | N/A | 5855 | 5870 | AGGAGGCGAGTCCAGG | 92 | 364 |
| 1063477 | N/A | N/A | 6012 | 6027 | AAGGACCGAGCTGACA | 53 | 365 |
| 1063509 | N/A | N/A | 6133 | 6148 | GCGAGAAGTGGGTAGA | 47 | 366 |
| 1063541 | N/A | N/A | 6280 | 6295 | TCCTCGGAGTCCTATT | 116 | 367 |
| 1063573 | N/A | N/A | 6449 | 6464 | GGCTTGCCTGCCCACG | 134 | 368 |
| 1063605 | N/A | N/A | 6969 | 6984 | GTCCAGGTACCCCACC | 65 | 369 |
| 1063637 | N/A | N/A | 7171 | 7186 | ACAATACGGCCTCCTC | 92 | 370 |
| 1063669 | N/A | N/A | 7376 | 7391 | ACTGCAAGCCCACATG | 56 | 371 |
| 1063701 | N/A | N/A | 7802 | 7817 | CTGAGGTGTTACCAGG | 78 | 372 |
| 1063733 | N/A | N/A | 7968 | 7983 | CTGCATCTTTAAGGTT | 56 | 373 |
| 1063765 | N/A | N/A | 8045 | 8060 | GCTTAAAGACGGCCAT | 96 | 374 |
| 1063796 | N/A | N/A | 8559 | 8574 | ACTTATTGGGATGAAG | 70 | 375 |
| 1063828 | N/A | N/A | 8848 | 8863 | GTAGCAGGGCAAAGCA | 156 | 376 |
| 1063860 | N/A | N/A | 9051 | 9066 | TAAGGGTTGTGTGTAG | 136 | 377 |
| 1063892 | N/A | N/A | 9413 | 9428 | TGCCTAAGTAGGGAGA | 103 | 378 |
| 1063924 | N/A | N/A | 9644 | 9659 | AGGCTACGGTCTTCCC | 67 | 379 |
| 1063956 | N/A | N/A | 9960 | 9975 | AGAGGGTTTGTAAGTA | 78 | 380 |
| 1063988 | N/A | N/A | 10527 | 10542 | ATAAATTACCACCAGC | 41 | 381 |
| 1064020 | N/A | N/A | 10757 | 10772 | TTTCAAAGCAAGGACG | 81 | 382 |
| 1064052 | N/A | N/A | 11379 | 11394 | ATGGAGCTCCTTTGCA | 89 | 383 |
| 1064084 | N/A | N/A | 11550 | 11565 | AGGCATGGCCCCAATC | 168 | 384 |
| 1064118 | N/A | N/A | 11622 | 11637 | GCTCCTGGAATTACTT | 91 | 385 |
| 1064150 | N/A | N/A | 11717 | 11732 | GCTAAGCCCACAGGCC | 81 | 386 |
| 1064182 | N/A | N/A | 11803 | 11818 | TGAAAAGAAGCGGAGT | 80 | 387 |
| 1064214 | N/A | N/A | 11910 | 11925 | CGTCAACACCCGTGTC | 114 | 388 |
| 1064246 | N/A | N/A | 11978 | 11993 | GCAGGACCTCCTAGCT | 104 | 389 |
| 1064278 | N/A | N/A | 12199 | 12214 | GGAATGGAGGAACCCA | 133 | 390 |
| 1064310 | N/A | N/A | 12384 | 12399 | TCCAGGAGAGGGTTAG | 45 | 391 |
| 1064342 | N/A | N/A | 12578 | 12593 | ATCAAATGGGTGTTAC | 89 | 392 |
| 1064374 | N/A | N/A | 12781 | 12796 | AGTCAGCGATGATGAT | 64 | 393 |
| 1064406 | N/A | N/A | 12924 | 12939 | GAATTATCGAGTATCT | 99 | 394 |
| 1064438 | N/A | N/A | 13217 | 13232 | AAGGGATCAGGACTGA | 112 | 395 |

TABLE 10

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910956 | 1800 | 1815 | 14210 | 14225 | AGTAATCTGTGCGAGC | 19 | 250 |
| 911144 | N/A | N/A | 7355 | 7370 | TGCTATGATCATCCCC | 41 | 65 |
| 1062006 | 2 | 17 | 402 | 417 | TTTCGATGAGTGTGTG | 31 | 396 |
| 1062038 | 119 | 134 | 519 | 534 | CCTGGCTTGTGGGAAA | 86 | 397 |
| 1062070 | 311 | 326 | 6849 | 6864 | CTGGAAGGTTCCCCCT | 131 | 398 |
| 1062102 | 424 | 439 | 7489 | 7504 | GCCCCGGAGGGTGCCA | 99 | 399 |
| 1062134 | 595 | 610 | 7758 | 7773 | AAGACCCCAGTGGCGG | 57 | 400 |
| 1062166 | 754 | 769 | 8400 | 8415 | AGCAGTGGGTAGGAGC | 37 | 401 |
| 1062198 | 876 | 891 | 9466 | 9481 | GGAGGAGACATTGTGC | 107 | 402 |
| 1062230 | 1050 | 1065 | 11206 | 11221 | GGACGACAGGGCCTTG | 81 | 403 |
| 1062262 | 1183 | 1198 | 12053 | 12068 | CGCATGTTGTGGAACT | 66* | 404 |
| 1062294 | 1426 | 1441 | 13836 | 13851 | CTCCGTTTCTTGCGGA | 115 | 405 |
| 1062326 | 1593 | 1608 | 14003 | 14018 | CAGTGGAAACCTCACT | 118 | 406 |
| 1062358 | 1852 | 1867 | 14262 | 14277 | GAGGGACAGGATTGTG | 68 | 407 |
| 1062390 | 2028 | 2043 | 14438 | 14453 | GGGCACACCCCTGTGT | 128 | 408 |
| 1062422 | 2209 | 2224 | 14619 | 14634 | TTGGCAAGGCAGTGTG | 19 | 409 |
| 1062454 | N/A | N/A | 8299 | 8314 | CACTGACCTGTCCTTC | 70 | 410 |
| 1062486 | N/A | N/A | 13601 | 13616 | CTGCGATGGCACTTGA | 114 | 411 |
| 1062550 | N/A | N/A | 685 | 700 | TTACCTGGCTGGAATC | 129 | 412 |
| 1062582 | N/A | N/A | 867 | 882 | GACAGCATTTCAAGTT | 42 | 413 |
| 1062614 | N/A | N/A | 1109 | 1124 | AGATCGATGGAGTGTG | 59 | 414 |
| 1062646 | N/A | N/A | 1238 | 1253 | AAATGTAAAGGTCCTC | 40 | 415 |
| 1062679 | N/A | N/A | 1338 | 1353 | TAAAGCGATACAAGCA | 82 | 416 |
| 1062711 | N/A | N/A | 1476 | 1491 | CAGCCCTGAACAACCT | 123 | 417 |
| 1062743 | N/A | N/A | 1723 | 1738 | ATCGGCACTTGGTCAA | 44 | 418 |
| 1062775 | N/A | N/A | 1878 | 1893 | AATAGGACAACCTTTT | 74 | 419 |
| 1062807 | N/A | N/A | 2075 | 2090 | CCTATTAGGAGTAAGG | 127 | 420 |
| 1062839 | N/A | N/A | 2160 | 2175 | ATATATGTAATGGCTG | 24 | 421 |
| 1062871 | N/A | N/A | 2392 | 2407 | ACCTCTATAGTAAATG | 103 | 422 |
| 1062903 | N/A | N/A | 2609 | 2624 | GGTTTATTGTGTGTCA | 5 | 423 |
| 1062935 | N/A | N/A | 2732 | 2747 | GAATAGTCAGTCCATT | 64 | 424 |
| 1062967 | N/A | N/A | 2868 | 2883 | TAGAAAGCTTGGACAT | 100 | 425 |
| 1062999 | N/A | N/A | 3069 | 3084 | GTGCGAGAGGAGGATT | 71 | 426 |
| 1063031 | N/A | N/A | 3245 | 3260 | CATTAGGTGTCTGCAG | 59 | 427 |
| 1063063 | N/A | N/A | 3390 | 3405 | TGAGATCTAGGCTTGG | 23 | 428 |
| 1063095 | N/A | N/A | 3642 | 3657 | CATCACCACGCTCTGG | 117 | 429 |

TABLE 10-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063127 | N/A | N/A | 3864 | 3879 | CCCAAATACATGGCCA | 40 | 430 |
| 1063159 | N/A | N/A | 4104 | 4119 | GAATCATAGAACAGCA | 39 | 431 |
| 1063191 | N/A | N/A | 4228 | 4243 | TCTGAAGACCTGGCCC | 61 | 432 |
| 1063223 | N/A | N/A | 4406 | 4421 | TGCGCCGGGCTTCATC | 78 | 433 |
| 1063254 | N/A | N/A | 4575 | 4590 | CTGCACTGTCTGTTGG | 93 | 434 |
| 1063286 | N/A | N/A | 4712 | 4727 | CCAGAGCTAAGAATTC | 69 | 435 |
| 1063318 | N/A | N/A | 5083 | 5098 | GGCCTGGGAGAGCACT | 71 | 436 |
| 1063350 | N/A | N/A | 5276 | 5291 | GAGTATAGAAGGGTTC | 70 | 437 |
| 1063382 | N/A | N/A | 5496 | 5511 | TGGAAGGGACTGCCCA | 119 | 438 |
| 1063414 | N/A | N/A | 5656 | 5671 | CCTGTCCAAGCCACGC | 51 | 439 |
| 1063446 | N/A | N/A | 5856 | 5871 | AAGGAGGCGAGTCCAG | 127 | 440 |
| 1063478 | N/A | N/A | 6013 | 6028 | GAAGGACCGAGCTGAC | 104 | 441 |
| 1063510 | N/A | N/A | 6135 | 6150 | AGGCGAGAAGTGGGTA | 43 | 442 |
| 1063542 | N/A | N/A | 6281 | 6296 | CTCCTCGGAGTCCTAT | 33 | 443 |
| 1063574 | N/A | N/A | 6455 | 6470 | GCACCTGGCTTGCCTG | 59 | 444 |
| 1063606 | N/A | N/A | 6981 | 6996 | CGGCACCTGTAGGTCC | 113 | 445 |
| 1063638 | N/A | N/A | 7172 | 7187 | TACAATACGGCCTCCT | 54 | 446 |
| 1063670 | N/A | N/A | 7377 | 7392 | CACTGCAAGCCCACAT | 48 | 447 |
| 1063702 | N/A | N/A | 7803 | 7818 | GCTGAGGTGTTACCAG | 76 | 448 |
| 1063734 | N/A | N/A | 7980 | 7995 | GATTTTGACATTCTGC | 3 | 449 |
| 1063766 | N/A | N/A | 8046 | 8061 | AGCTTAAAGACGGCCA | 116 | 450 |
| 1063797 | N/A | N/A | 8560 | 8575 | TACTTATTGGGATGAA | 42 | 451 |
| 1063829 | N/A | N/A | 8850 | 8865 | GAGTAGCAGGGCAAAG | 112 | 452 |
| 1063861 | N/A | N/A | 9052 | 9067 | CTAAGGGTTGTGTGTA | 69 | 453 |
| 1063893 | N/A | N/A | 9414 | 9429 | GTGCCTAAGTAGGGAG | 48 | 454 |
| 1063925 | N/A | N/A | 9645 | 9660 | CAGGCTACGGTCTTCC | 113 | 455 |
| 1063957 | N/A | N/A | 9961 | 9976 | CAGAGGGTTTGTAAGT | 75 | 456 |
| 1063989 | N/A | N/A | 10541 | 10556 | TCGCATCATGAGAAAT | 58 | 457 |
| 1064021 | N/A | N/A | 11113 | 11128 | GCTTAAACTTCCCACT | 118 | 458 |
| 1064053 | N/A | N/A | 11380 | 11395 | CATGGAGCTCCTTTGC | 122 | 459 |
| 1064085 | N/A | N/A | 11551 | 11566 | GAGGCATGGCCCCAAT | 143 | 460 |
| 1064119 | N/A | N/A | 11633 | 11648 | GGAAAGGAGGTGCTCC | 125 | 461 |
| 1064151 | N/A | N/A | 11719 | 11734 | CTGCTAAGCCCACAGG | 86 | 462 |
| 1064183 | N/A | N/A | 11804 | 11819 | TTGAAAAGAAGCGGAG | 55 | 463 |
| 1064215 | N/A | N/A | 11913 | 11928 | CACCGTCAACACCCGT | 58 | 464 |
| 1064247 | N/A | N/A | 11980 | 11995 | ATGCAGGACCTCCTAG | 131 | 465 |

TABLE 10-continued

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064279 | N/A | N/A | 12200 | 12215 | GGGAATGGAGGAACCC | 113 | 466 |
| 1064311 | N/A | N/A | 12385 | 12400 | GTCCAGGAGAGGGTTA | 88 | 467 |
| 1064343 | N/A | N/A | 12579 | 12594 | GATCAAATGGGTGTTA | 81 | 468 |
| 1064375 | N/A | N/A | 12784 | 12799 | CAGAGTCAGCGATGAT | 98 | 469 |
| 1064407 | N/A | N/A | 12925 | 12940 | TGAATTATCGAGTATC | 86 | 470 |
| 1064439 | N/A | N/A | 13219 | 13234 | GTAAGGGATCAGGACT | 66 | 471 |

TABLE 11

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910956 | 1800 | 1815 | 14210 | 14225 | AGTAATCTGTGCGAGC | 18 | 250 |
| 911144 | N/A | N/A | 7355 | 7370 | TGCTATGATCATCCCC | 36 | 65 |
| 1062008 | 4 | 19 | 404 | 419 | TTTTTCGATGAGTGTG | 13 | 472 |
| 1062040 | 128 | 143 | 528 | 543 | AAGGATCAGCCTGGCT | 111 | 473 |
| 1062072 | 313 | 328 | 6851 | 6866 | CCCTGGAAGGTTCCCC | 92 | 474 |
| 1062104 | 459 | 474 | 7524 | 7539 | GGAGTGCCTGTAAGTG | 78 | 475 |
| 1062136 | 597 | 612 | 7760 | 7775 | AGAAGACCCCAGTGGC | 98 | 476 |
| 1062168 | 766 | 781 | 8412 | 8427 | ACACCATTTGCCAGCA | 119 | 477 |
| 1062200 | 878 | 893 | 9468 | 9483 | CTGGAGGAGACATTGT | 64 | 478 |
| 1062232 | 1091 | 1106 | 11247 | 11262 | AAACAGGCTGTCAGGG | 129 | 479 |
| 1062264 | 1185 | 1200 | 12055 | 12070 | GTCGCATGTTGTGGAA | 5* | 480 |
| 1062296 | 1430 | 1445 | 13840 | 13855 | CTGGCTCCGTTTCTTG | 91 | 481 |
| 1062328 | 1595 | 1610 | 14005 | 14020 | GACAGTGGAAACCTCA | 71 | 482 |
| 1062360 | 1854 | 1869 | 14264 | 14279 | GTGAGGGACAGGATTG | 76 | 483 |
| 1062392 | 2040 | 2055 | 14450 | 14465 | GTGTAGGCCTCTGGGC | 201 | 484 |
| 1062424 | 2212 | 2227 | 14622 | 14637 | TTTTTGGCAAGGCAGT | 154 | 485 |
| 1062456 | N/A | N/A | 8301 | 8316 | TCCACTGACCTGTCCT | 74 | 486 |
| 1062488 | N/A | N/A | 13603 | 13618 | AGCTGCGATGGCACTT | 123 | 487 |
| 1062520 | N/A | N/A | 553 | 568 | ACCTTGGTGAAGTGGA | 60 | 488 |
| 1062552 | N/A | N/A | 687 | 702 | CCTTACCTGGCTGGAA | 130 | 489 |
| 1062584 | N/A | N/A | 879 | 894 | CAGTTGCACCTGGACA | 81 | 490 |
| 1062616 | N/A | N/A | 1111 | 1126 | GGAGATCGATGGAGTG | 93 | 491 |
| 1062648 | N/A | N/A | 1259 | 1274 | GAACTGATGCTCACTC | 78 | 492 |
| 1062681 | N/A | N/A | 1340 | 1355 | TCTAAAGCGATACAAG | 104 | 493 |

TABLE 11-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062713 | N/A | N/A | 1490 | 1505 | AATCGAGCTCACCCCA | 208 | 494 |
| 1062745 | N/A | N/A | 1726 | 1741 | ACAATCGGCACTTGGT | 84 | 495 |
| 1062777 | N/A | N/A | 1886 | 1901 | GAGCATAAAATAGGAC | 93 | 496 |
| 1062809 | N/A | N/A | 2077 | 2092 | ACCCTATTAGGAGTAA | 133 | 497 |
| 1062841 | N/A | N/A | 2234 | 2249 | CATCATAAGCATCACA | 101 | 498 |
| 1062873 | N/A | N/A | 2396 | 2411 | CTTAACCTCTATAGTA | 106 | 499 |
| 1062905 | N/A | N/A | 2616 | 2631 | GATCTTGGGTTTATTG | 207 | 500 |
| 1062937 | N/A | N/A | 2735 | 2750 | AGTGAATAGTCAGTCC | 76 | 501 |
| 1062969 | N/A | N/A | 2905 | 2920 | CCTGGTATAAGAACAG | 86 | 502 |
| 1063001 | N/A | N/A | 3100 | 3115 | GGACACATGCATGGAG | 95 | 503 |
| 1063033 | N/A | N/A | 3248 | 3263 | AGTCATTAGGTGTCTG | 49 | 504 |
| 1063065 | N/A | N/A | 3392 | 3407 | CCTGAGATCTAGGCTT | 77 | 505 |
| 1063097 | N/A | N/A | 3658 | 3673 | ACTGACATGCCTCCAT | 32 | 506 |
| 1063129 | N/A | N/A | 3884 | 3899 | GTCCACTCTGGAACAA | 123 | 507 |
| 1063161 | N/A | N/A | 4123 | 4138 | GTATAACACCAGGACC | 135 | 508 |
| 1063193 | N/A | N/A | 4236 | 4251 | CCCCTAGCTCTGAAGA | 106 | 509 |
| 1063225 | N/A | N/A | 4414 | 4429 | CGGCCGGATGCGCCGG | 158 | 510 |
| 1063256 | N/A | N/A | 4584 | 4599 | GCCGGCTTCCTGCACT | 145 | 511 |
| 1063288 | N/A | N/A | 4714 | 4729 | GGCCAGAGCTAAGAAT | 52 | 512 |
| 1063320 | N/A | N/A | 5094 | 5109 | CTCCGAACAAGGGCCT | 41 | 513 |
| 1063352 | N/A | N/A | 5313 | 5328 | CTGAGTTGGGCACACA | 93 | 514 |
| 1063384 | N/A | N/A | 5521 | 5536 | TCCTGGTCTGAGAGGA | 170 | 515 |
| 1063416 | N/A | N/A | 5686 | 5701 | GCCTCAAATGCCCACT | 91 | 516 |
| 1063448 | N/A | N/A | 5858 | 5873 | GCAAGGAGGCGAGTCC | 57 | 517 |
| 1063480 | N/A | N/A | 6015 | 6030 | TGGAAGGACCGAGCTG | 101 | 518 |
| 1063512 | N/A | N/A | 6139 | 6154 | GAGAAGGCGAGAAGTG | 109 | 519 |
| 1063544 | N/A | N/A | 6293 | 6308 | GTCTCGGACTTTCTCC | 217 | 520 |
| 1063576 | N/A | N/A | 6483 | 6498 | CCACACATGCCCCACG | 95 | 521 |
| 1063608 | N/A | N/A | 6983 | 6998 | GTCGGCACCTGTAGGT | 122 | 522 |
| 1063640 | N/A | N/A | 7175 | 7190 | GACTACAATACGGCCT | 83 | 523 |
| 1063672 | N/A | N/A | 7382 | 7397 | CTCTGCACTGCAAGCC | 91 | 524 |
| 1063704 | N/A | N/A | 7867 | 7882 | AGCCTACACTGCTCAC | 69 | 525 |
| 1063736 | N/A | N/A | 8001 | 8016 | TGTAAAGCTCTGTGGT | 61 | 526 |
| 1063768 | N/A | N/A | 8048 | 8063 | GAAGCTTAAAGACGGC | 34 | 527 |
| 1063799 | N/A | N/A | 8563 | 8578 | TACTACTTATTGGGAT | 158 | 528 |
| 1063831 | N/A | N/A | 8852 | 8867 | AGGAGTAGCAGGGCAA | 76 | 529 |

TABLE 11-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063863 | N/A | N/A | 9054 | 9069 | TGCTAAGGGTTGTGTG | 108 | 530 |
| 1063895 | N/A | N/A | 9425 | 9440 | TCCGCCTGGCAGTGCC | 25 | 531 |
| 1063927 | N/A | N/A | 9687 | 9702 | ACATGAGGCCTCAGCC | 111 | 532 |
| 1063959 | N/A | N/A | 9963 | 9978 | GTCAGAGGGTTTGTAA | 63 | 533 |
| 1063991 | N/A | N/A | 10543 | 10558 | ATTCGCATCATGAGAA | 188 | 534 |
| 1064023 | N/A | N/A | 11115 | 11130 | AGGCTTAAACTTCCCA | 119 | 535 |
| 1064055 | N/A | N/A | 11383 | 11398 | CAGCATGGAGCTCCTT | 98 | 536 |
| 1064087 | N/A | N/A | 11554 | 11569 | GGTGAGGCATGGCCCC | 86 | 537 |
| 1064121 | N/A | N/A | 11653 | 11668 | GATTTTCCTTGGTCAG | 51 | 538 |
| 1064153 | N/A | N/A | 11728 | 11743 | CTCTGATCCCTGCTAA | 139 | 539 |
| 1064185 | N/A | N/A | 11810 | 11825 | CCGAGGTTGAAAAGAA | 150 | 540 |
| 1064217 | N/A | N/A | 11919 | 11934 | AGATCTCACCGTCAAC | 142 | 541 |
| 1064249 | N/A | N/A | 11984 | 11999 | CCCCATGCAGGACCTC | 96 | 542 |
| 1064281 | N/A | N/A | 12202 | 12217 | TTGGGAATGGAGGAAC | 151 | 543 |
| 1064313 | N/A | N/A | 12396 | 12411 | CTATTTTATGGGTCCA | 13 | 544 |
| 1064345 | N/A | N/A | 12584 | 12599 | TTAAGGATCAAATGGG | 65 | 545 |
| 1064377 | N/A | N/A | 12786 | 12801 | TACAGAGTCAGCGATG | 82 | 546 |
| 1064409 | N/A | N/A | 12927 | 12942 | TTTGAATTATCGAGTA | 83 | 547 |
| 1064441 | N/A | N/A | 13221 | 13236 | AGGTAAGGGATCAGGA | 150 | 548 |

TABLE 12

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910956 | 1800 | 1815 | 14210 | 14225 | AGTAATCTGTGCGAGC | 17 | 250 |
| 911144 | N/A | N/A | 7355 | 7370 | TGCTATGATCATCCCC | 53 | 65 |
| 1062009 | 5 | 20 | 405 | 420 | TTTTTTCGATGAGTGT | 35 | 549 |
| 1062041 | 143 | 158 | 543 | 558 | AGTGGACTGACAGAAA | 117 | 550 |
| 1062073 | 314 | 329 | 6852 | 6867 | GCCCTGGAAGGTTCCC | 94 | 551 |
| 1062105 | 461 | 476 | 7526 | 7541 | GAGGAGTGCCTGTAAG | 103 | 552 |
| 1062137 | 600 | 615 | 7763 | 7778 | GGGAGAAGACCCCAGT | 107 | 553 |
| 1062169 | 771 | 786 | 8417 | 8432 | TGCAGACACCATTTGC | 159 | 554 |
| 1062201 | 895 | 910 | 9485 | 9500 | GACTGTACCATCTCTC | 126 | 555 |
| 1062233 | 1098 | 1113 | 11254 | 11269 | GGACAGCAAACAGGCT | 122 | 556 |
| 1062265 | 1186 | 1201 | 12056 | 12071 | GGTCGCATGTTGTGGA | 1* | 557 |
| 1062297 | 1433 | 1448 | 13843 | 13858 | CCTCTGGCTCCGTTTC | 110 | 558 |

TABLE 12-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062329 | 1596 | 1611 | 14006 | 14021 | AGACAGTGGAAACCTC | 117 | 559 |
| 1062361 | 1856 | 1871 | 14266 | 14281 | GAGTGAGGGACAGGAT | 95 | 560 |
| 1062393 | 2041 | 2056 | 14451 | 14466 | TGTGTAGGCCTCTGGG | 32 | 561 |
| 1062425 | 2215 | 2230 | 14625 | 14640 | GTATTTTTGGCAAGGC | 14 | 562 |
| 1062457 | N/A | N/A | 8304 | 8319 | CTGTCCACTGACCTGT | 160 | 563 |
| 1062489 | N/A | N/A | 13609 | 13624 | ACTTTGAGCTGCGATG | 63 | 564 |
| 1062521 | N/A | N/A | 554 | 569 | CACCTTGGTGAAGTGG | 144 | 565 |
| 1062553 | N/A | N/A | 688 | 703 | ACCTTACCTGGCTGGA | 141 | 566 |
| 1062585 | N/A | N/A | 880 | 895 | TCAGTTGCACCTGGAC | 118 | 567 |
| 1062617 | N/A | N/A | 1112 | 1127 | AGGAGATCGATGGAGT | 100 | 568 |
| 1062649 | N/A | N/A | 1260 | 1275 | AGAACTGATGCTCACT | 82 | 569 |
| 1062682 | N/A | N/A | 1341 | 1356 | CTCTAAAGCGATACAA | 125 | 570 |
| 1062714 | N/A | N/A | 1491 | 1506 | GAATCGAGCTCACCCC | 112 | 571 |
| 1062746 | N/A | N/A | 1727 | 1742 | AACAATCGGCACTTGG | 56 | 572 |
| 1062778 | N/A | N/A | 1887 | 1902 | GGAGCATAAAATAGGA | 97 | 573 |
| 1062810 | N/A | N/A | 2078 | 2093 | CACCCTATTAGGAGTA | 95 | 574 |
| 1062842 | N/A | N/A | 2235 | 2250 | CCATCATAAGCATCAC | 76 | 575 |
| 1062874 | N/A | N/A | 2397 | 2412 | TCTTAACCTCTATAGT | 105 | 576 |
| 1062906 | N/A | N/A | 2618 | 2633 | CTGATCTTGGGTTTAT | 63 | 577 |
| 1062938 | N/A | N/A | 2736 | 2751 | GAGTGAATAGTCAGTC | 21 | 578 |
| 1062970 | N/A | N/A | 2920 | 2935 | GCAAAACAGTGTGGCC | 112 | 579 |
| 1063002 | N/A | N/A | 3125 | 3140 | GATAGTGAGAGACATT | 73 | 580 |
| 1063034 | N/A | N/A | 3249 | 3264 | AAGTCATTAGGTGTCT | 77 | 581 |
| 1063066 | N/A | N/A | 3393 | 3408 | TCCTGAGATCTAGGCT | 101 | 582 |
| 1063098 | N/A | N/A | 3666 | 3681 | CCTGACTGACTGACAT | 148 | 583 |
| 1063130 | N/A | N/A | 3886 | 3901 | CTGTCCACTCTGGAAC | 121 | 584 |
| 1063162 | N/A | N/A | 4124 | 4139 | AGTATAACACCAGGAC | 54 | 585 |
| 1063194 | N/A | N/A | 4243 | 4258 | TGACAAGCCCCTAGCT | 121 | 586 |
| 1063226 | N/A | N/A | 4418 | 4433 | ATGGCGGCCGGATGCG | 103 | 587 |
| 1063257 | N/A | N/A | 4586 | 4601 | CAGCCGGCTTCCTGCA | 124 | 588 |
| 1063289 | N/A | N/A | 4719 | 4734 | CACTTGGCCAGAGCTA | 88 | 589 |
| 1063321 | N/A | N/A | 5095 | 5110 | GCTCCGAACAAGGGCC | 177 | 590 |
| 1063353 | N/A | N/A | 5314 | 5329 | ACTGAGTTGGGCACAC | 62 | 591 |
| 1063385 | N/A | N/A | 5522 | 5537 | ATCCTGGTCTGAGAGG | 138 | 592 |
| 1063417 | N/A | N/A | 5727 | 5742 | CCAATTTCTGGCCCTC | 115 | 593 |
| 1063449 | N/A | N/A | 5859 | 5874 | GGCAAGGAGGCGAGTC | 65 | 594 |
| 1063481 | N/A | N/A | 6016 | 6031 | CTGGAAGGACCGAGCT | 75 | 595 |

TABLE 12-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063513 | N/A | N/A | 6140 | 6155 | GGAGAAGGCGAGAAGT | 95 | 596 |
| 1063545 | N/A | N/A | 6303 | 6318 | GCCGGAGCTGGTCTCG | 108 | 597 |
| 1063577 | N/A | N/A | 6563 | 6578 | CCATAGTTGCACCCCA | 135 | 598 |
| 1063609 | N/A | N/A | 6985 | 7000 | AGGTCGGCACCTGTAG | 126 | 599 |
| 1063641 | N/A | N/A | 7176 | 7191 | GGACTACAATACGGCC | 118 | 600 |
| 1063673 | N/A | N/A | 7387 | 7402 | AAATACTCTGCACTGC | 105 | 601 |
| 1063705 | N/A | N/A | 7868 | 7883 | TAGCCTACACTGCTCA | 118 | 602 |
| 1063737 | N/A | N/A | 8006 | 8021 | AGCTTTGTAAAGCTCT | 117 | 603 |
| 1063769 | N/A | N/A | 8049 | 8064 | AGAAGCTTAAAGACGG | 11 | 604 |
| 1063800 | N/A | N/A | 8564 | 8579 | TTACTACTTATTGGGA | 103 | 605 |
| 1063832 | N/A | N/A | 8854 | 8869 | TGAGGAGTAGCAGGGC | 72 | 606 |
| 1063864 | N/A | N/A | 9055 | 9070 | CTGCTAAGGGTTGTGT | 104 | 607 |
| 1063896 | N/A | N/A | 9503 | 9518 | ATTACCTGCTGCTCCA | 142 | 608 |
| 1063928 | N/A | N/A | 9688 | 9703 | AACATGAGGCCTCAGC | 80 | 609 |
| 1063960 | N/A | N/A | 10283 | 10298 | TCTTAGAGTCAGAGGG | 45 | 610 |
| 1063992 | N/A | N/A | 10545 | 10560 | ACATTCGCATCATGAG | 57 | 611 |
| 1064024 | N/A | N/A | 11116 | 11131 | GAGGCTTAAACTTCCC | 104 | 612 |
| 1064056 | N/A | N/A | 11386 | 11401 | GGGCAGCATGGAGCTC | 157 | 613 |
| 1064088 | N/A | N/A | 11560 | 11575 | AGAGTGGGTGAGGCAT | 133 | 614 |
| 1064122 | N/A | N/A | 11654 | 11669 | CGATTTTCCTTGGTCA | 42 | 615 |
| 1064154 | N/A | N/A | 11729 | 11744 | TCTCTGATCCCTGCTA | 71 | 616 |
| 1064186 | N/A | N/A | 11811 | 11826 | CCCGAGGTTGAAAAGA | 118 | 617 |
| 1064218 | N/A | N/A | 11920 | 11935 | GAGATCTCACCGTCAA | 71 | 618 |
| 1064250 | N/A | N/A | 11987 | 12002 | AAGCCCCATGCAGGAC | 154 | 619 |
| 1064282 | N/A | N/A | 12240 | 12255 | CATTTGAGGCACGGCT | 140 | 620 |
| 1064314 | N/A | N/A | 12399 | 12414 | AGGCTATTTTATGGGT | 102 | 621 |
| 1064346 | N/A | N/A | 12585 | 12600 | GTTAAGGATCAAATGG | 117 | 622 |
| 1064378 | N/A | N/A | 12787 | 12802 | TTACAGAGTCAGCGAT | 125 | 623 |
| 1064410 | N/A | N/A | 12936 | 12951 | CAGAGATGGTTTGAAT | 67 | 624 |
| 1064442 | N/A | N/A | 13222 | 13237 | TAGGTAAGGGATCAGG | 79 | 625 |

TABLE 13

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910956 | 1800 | 1815 | 14210 | 14225 | AGTAATCTGTGCGAGC | 40 | 250 |
| 911144 | N/A | N/A | 7355 | 7370 | TGCTATGATCATCCCC | 28 | 65 |
| 1062010 | 6 | 21 | 406 | 421 | TTTTTTTCGATGAGTG | 22 | 627 |

TABLE 13-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062042 | 145 | 160 | 545 | 560 | GAAGTGGACTGACAGA | 58 | 628 |
| 1062074 | 316 | 331 | 6854 | 6869 | CGGCCCTGGAAGGTTC | 149 | 629 |
| 1062106 | 462 | 477 | 7527 | 7542 | GGAGGAGTGCCTGTAA | 89 | 630 |
| 1062138 | 614 | 629 | 7777 | 7792 | AGGCCGGGCCTTGAGG | 138 | 631 |
| 1062170 | 793 | 808 | 8439 | 8454 | ACCTTCTCACATCCGG | 61 | 632 |
| 1062202 | 896 | 911 | 9486 | 9501 | AGACTGTACCATCTCT | 135 | 633 |
| 1062234 | 1100 | 1115 | 11256 | 11271 | CCGGACAGCAAACAGG | 105 | 634 |
| 1062266 | 1248 | 1263 | 13478 | 13493 | TCCGCTGCTTCTCTGG | 7* | 635 |
| 1062298 | 1449 | 1464 | 13859 | 13874 | TGGAACACCTGCTGGG | 231 | 636 |
| 1062330 | 1599 | 1614 | 14009 | 14024 | GCAAGACAGTGGAAAC | 88 | 637 |
| 1062362 | 1887 | 1902 | 14297 | 14312 | GGCAGGCTCTCTGTGT | 84 | 638 |
| 1062394 | 2042 | 2057 | 14452 | 14467 | CTGTGTAGGCCTCTGG | 50 | 639 |
| 1062426 | 2245 | 2260 | 14655 | 14670 | GAGTGAGGTGAGTGGC | 43 | 640 |
| 1062458 | N/A | N/A | 8321 | 8336 | GAGGATCCTTCCCAGC | 156 | 641 |
| 1062490 | N/A | N/A | 13610 | 13625 | CACTTTGAGCTGCGAT | 185 | 642 |
| 1062522 | N/A | N/A | 555 | 570 | TCACCTTGGTGAAGTG | 137 | 643 |
| 1062554 | N/A | N/A | 689 | 704 | GACCTTACCTGGCTGG | 105 | 644 |
| 1062586 | N/A | N/A | 884 | 899 | ATTTTCAGTTGCACCT | 123 | 645 |
| 1062618 | N/A | N/A | 1113 | 1128 | AAGGAGATCGATGGAG | 140 | 646 |
| 1062650 | N/A | N/A | 1261 | 1276 | CAGAACTGATGCTCAC | 53 | 647 |
| 1062683 | N/A | N/A | 1342 | 1357 | CCTCTAAAGCGATACA | 70 | 648 |
| 1062715 | N/A | N/A | 1492 | 1507 | AGAATCGAGCTCACCC | 67 | 649 |
| 1062747 | N/A | N/A | 1728 | 1743 | CAACAATCGGCACTTG | 117 | 650 |
| 1062779 | N/A | N/A | 1889 | 1904 | AGGGAGCATAAAATAG | 135 | 651 |
| 1062811 | N/A | N/A | 2079 | 2094 | ACACCCTATTAGGAGT | 101 | 652 |
| 1062843 | N/A | N/A | 2237 | 2252 | AACCATCATAAGCATC | 78 | 653 |
| 1062875 | N/A | N/A | 2398 | 2413 | CTCTTAACCTCTATAG | 133 | 654 |
| 1062907 | N/A | N/A | 2619 | 2634 | GCTGATCTTGGGTTTA | 38 | 655 |
| 1062939 | N/A | N/A | 2737 | 2752 | TGAGTGAATAGTCAGT | 59 | 656 |
| 1062971 | N/A | N/A | 2940 | 2955 | GTATTGCAAAGCAACA | 217 | 657 |
| 1063003 | N/A | N/A | 3133 | 3148 | GAACAAGAGATAGTGA | 118 | 658 |
| 1063035 | N/A | N/A | 3251 | 3266 | TTAAGTCATTAGGTGT | 56 | 659 |
| 1063067 | N/A | N/A | 3395 | 3410 | AGTCCTGAGATCTAGG | 55 | 660 |
| 1063099 | N/A | N/A | 3668 | 3683 | AGCCTGACTGACTGAC | 52 | 661 |
| 1063131 | N/A | N/A | 3905 | 3920 | CCCTAGGGCCTCAGTC | 144 | 662 |
| 1063163 | N/A | N/A | 4125 | 4140 | TAGTATAACACCAGGA | 44 | 663 |
| 1063195 | N/A | N/A | 4245 | 4260 | TATGACAAGCCCCTAG | 156 | 664 |

TABLE 13-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063227 | N/A | N/A | 4421 | 4436 | GTCATGGCGGCCGGAT | 121 | 665 |
| 1063258 | N/A | N/A | 4589 | 4604 | GGGCAGCCGGCTTCCT | 209 | 666 |
| 1063290 | N/A | N/A | 4720 | 4735 | ACACTTGGCCAGAGCT | 102 | 667 |
| 1063322 | N/A | N/A | 5117 | 5132 | ACAGGAGTGTGGGTCT | 164 | 668 |
| 1063354 | N/A | N/A | 5318 | 5333 | CAGCACTGAGTTGGGC | 106 | 669 |
| 1063386 | N/A | N/A | 5524 | 5539 | TAATCCTGGTCTGAGA | 113 | 670 |
| 1063418 | N/A | N/A | 5728 | 5743 | CCCAATTTCTGGCCCT | 95 | 671 |
| 1063450 | N/A | N/A | 5860 | 5875 | GGGCAAGGAGGCGAGT | 76 | 672 |
| 1063482 | N/A | N/A | 6017 | 6032 | GCTGGAAGGACCGAGC | 199 | 673 |
| 1063514 | N/A | N/A | 6158 | 6173 | GAATGGGCTGGTGGCA | 103 | 674 |
| 1063546 | N/A | N/A | 6363 | 6378 | TTTCAAGCCTCAGGCC | 169 | 675 |
| 1063578 | N/A | N/A | 6565 | 6580 | CCCCATAGTTGCACCC | 48 | 676 |
| 1063610 | N/A | N/A | 6986 | 7001 | AAGGTCGGCACCTGTA | 162 | 677 |
| 1063642 | N/A | N/A | 7195 | 7210 | ACACATAGCTATGCTC | 125 | 678 |
| 1063674 | N/A | N/A | 7388 | 7403 | CAAATACTCTGCACTG | 104 | 679 |
| 1063706 | N/A | N/A | 7869 | 7884 | ATAGCCTACACTGCTC | 219 | 680 |
| 1063738 | N/A | N/A | 8009 | 8024 | ACTAGCTTTGTAAAGC | 150 | 681 |
| 1063770 | N/A | N/A | 8056 | 8071 | CTGGCAGAGAAGCTTA | 207 | 682 |
| 1063801 | N/A | N/A | 8566 | 8581 | TCTTACTACTTATTGG | 88 | 683 |
| 1063833 | N/A | N/A | 8856 | 8871 | CATGAGGAGTAGCAGG | 291 | 684 |
| 1063865 | N/A | N/A | 9056 | 9071 | GCTGCTAAGGGTTGTG | 176 | 685 |
| 1063897 | N/A | N/A | 9504 | 9519 | CATTACCTGCTGCTCC | 120 | 686 |
| 1063929 | N/A | N/A | 9689 | 9704 | AAACATGAGGCCTCAG | 214 | 687 |
| 1063961 | N/A | N/A | 10285 | 10300 | GATCTTAGAGTCAGAG | 111 | 688 |
| 1063993 | N/A | N/A | 10547 | 10562 | GTACATTCGCATCATG | 80 | 689 |
| 1064025 | N/A | N/A | 11117 | 11132 | AGAGGCTTAAACTTCC | 131 | 690 |
| 1064057 | N/A | N/A | 11445 | 11460 | CGGATGCATTTTCCCA | 250 | 691 |
| 1064089 | N/A | N/A | 11564 | 11579 | GTCCAGAGTGGGTGAG | 78 | 692 |
| 1064123 | N/A | N/A | 11655 | 11670 | CCGATTTTCCTTGGTC | 111 | 693 |
| 1064155 | N/A | N/A | 11735 | 11750 | TCAAGGTCTCTGATCC | 96 | 694 |
| 1064187 | N/A | N/A | 11813 | 11828 | TCCCCGAGGTTGAAAA | 173 | 695 |
| 1064219 | N/A | N/A | 11922 | 11937 | CTGAGATCTCACCGTC | 121 | 696 |
| 1064251 | N/A | N/A | 11990 | 12005 | ATCAAGCCCCATGCAG | 144 | 697 |
| 1064283 | N/A | N/A | 12241 | 12256 | ACATTTGAGGCACGGC | 86 | 698 |
| 1064315 | N/A | N/A | 12430 | 12445 | TAGGGCAAGGTGCAGA | 86 | 699 |
| 1064347 | N/A | N/A | 12586 | 12601 | AGTTAAGGATCAAATG | 172 | 700 |
| 1064379 | N/A | N/A | 12788 | 12803 | ATTACAGAGTCAGCGA | 105 | 701 |

TABLE 13-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064411 | N/A | N/A | 12937 | 12952 | CCAGAGATGGTTTGAA | 186 | 702 |
| 1064443 | N/A | N/A | 13223 | 13238 | TTAGGTAAGGGATCAG | 113 | 703 |

TABLE 14

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 895475 | N/A | N/A | 4422 | 4437 | CGTCATGGCGGCCGGA | 96 | 704 |
| 910956 | 1800 | 1815 | 14210 | 14225 | AGTAATCTGTGCGAGC | 27 | 250 |
| 911144 | N/A | N/A | 7355 | 7370 | TGCTATGATCATCCCC | 42 | 65 |
| 1062011 | 8 | 23 | 408 | 423 | AATTTTTTTCGATGAG | 80 | 705 |
| 1062043 | 146 | 161 | 546 | 561 | TGAAGTGGACTGACAG | 83 | 706 |
| 1062075 | 318 | 333 | 6856 | 6871 | CTCGGCCCTGGAAGGT | 106 | 707 |
| 1062107 | 463 | 478 | 7528 | 7543 | TGGAGGAGTGCCTGTA | 64 | 708 |
| 1062139 | 615 | 630 | 7778 | 7793 | CAGGCCGGGCCTTGAG | 95 | 709 |
| 1062171 | 796 | 811 | 8442 | 8457 | AAGACCTTCTCACATC | 80 | 710 |
| 1062203 | 897 | 912 | 9487 | 9502 | GAGACTGTACCATCTC | 145 | 711 |
| 1062235 | 1101 | 1116 | 11257 | 11272 | TCCGGACAGCAAACAG | 120 | 712 |
| 1062267 | 1251 | 1266 | 13481 | 13496 | GTGTCCGCTGCTTCTC | 3* | 713 |
| 1062299 | 1450 | 1465 | 13860 | 13875 | TTGGAACACCTGCTGG | 48 | 714 |
| 1062331 | 1738 | 1753 | 14148 | 14163 | TGCAGGGCTCGACTGG | 42 | 715 |
| 1062363 | 1894 | 1909 | 14304 | 14319 | GTACTGAGGCAGGCTC | 57 | 716 |
| 1062395 | 2043 | 2058 | 14453 | 14468 | TCTGTGTAGGCCTCTG | 11 | 717 |
| 1062427 | 2268 | 2283 | N/A | N/A | ATGGATCAGGGCTCAG | 28 | 718 |
| 1062459 | N/A | N/A | 8322 | 8337 | CGAGGATCCTTCCCAG | 144 | 719 |
| 1062491 | N/A | N/A | 13611 | 13626 | CCACTTTGAGCTGCGA | 98 | 720 |
| 1062523 | N/A | N/A | 556 | 571 | CTCACCTTGGTGAAGT | 131 | 721 |
| 1062555 | N/A | N/A | 690 | 705 | AGACCTTACCTGGCTG | 108 | 722 |
| 1062587 | N/A | N/A | 885 | 900 | AATTTTCAGTTGCACC | 96 | 723 |
| 1062619 | N/A | N/A | 1114 | 1129 | AAAGGAGATCGATGGA | 80 | 724 |
| 1062651 | N/A | N/A | 1263 | 1278 | AACAGAACTGATGCTC | 77 | 725 |
| 1062684 | N/A | N/A | 1343 | 1358 | TCCTCTAAAGCGATAC | 99 | 726 |
| 1062716 | N/A | N/A | 1493 | 1508 | CAGAATCGAGCTCACC | 58 | 727 |
| 1062748 | N/A | N/A | 1730 | 1745 | TCCAACAATCGGCACT | 78 | 728 |
| 1062780 | N/A | N/A | 1894 | 1909 | AGTAGAGGGAGCATAA | 100 | 729 |
| 1062812 | N/A | N/A | 2080 | 2095 | AACACCCTATTAGGAG | 77 | 730 |
| 1062844 | N/A | N/A | 2253 | 2268 | CTATTTGACTGTATAA | 134 | 731 |

TABLE 14-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062876 | N/A | N/A | 2407 | 2422 | GTACCCACACTCTTAA | 100 | 732 |
| 1062908 | N/A | N/A | 2623 | 2638 | TAATGCTGATCTTGGG | 36 | 733 |
| 1062940 | N/A | N/A | 2739 | 2754 | ATTGAGTGAATAGTCA | 69 | 734 |
| 1062972 | N/A | N/A | 2943 | 2958 | ATTGTATTGCAAAGCA | 62 | 735 |
| 1063004 | N/A | N/A | 3144 | 3159 | CGAGCAAGAGAGAACA | 126 | 736 |
| 1063036 | N/A | N/A | 3252 | 3267 | GTTAAGTCATTAGGTG | 27 | 737 |
| 1063068 | N/A | N/A | 3396 | 3411 | GAGTCCTGAGATCTAG | 62 | 738 |
| 1063100 | N/A | N/A | 3710 | 3725 | AATCAAGGTTTTCGGG | 69 | 739 |
| 1063132 | N/A | N/A | 3906 | 3921 | TCCCTAGGGCCTCAGT | 81 | 740 |
| 1063164 | N/A | N/A | 4126 | 4141 | ATAGTATAACACCAGG | 31 | 741 |
| 1063196 | N/A | N/A | 4246 | 4261 | CTATGACAAGCCCCTA | 96 | 742 |
| 1063259 | N/A | N/A | 4591 | 4606 | CTGGGCAGCCGGCTTC | 104 | 743 |
| 1063291 | N/A | N/A | 4721 | 4736 | GACACTTGGCCAGAGC | 100 | 744 |
| 1063323 | N/A | N/A | 5118 | 5133 | AACAGGAGTGTGGGTC | 61 | 745 |
| 1063355 | N/A | N/A | 5321 | 5336 | TCACAGCACTGAGTTG | 82 | 746 |
| 1063387 | N/A | N/A | 5526 | 5541 | TATAATCCTGGTCTGA | 100 | 747 |
| 1063419 | N/A | N/A | 5729 | 5744 | CCCCAATTTCTGGCCC | 54 | 748 |
| 1063451 | N/A | N/A | 5862 | 5877 | CAGGGCAAGGAGGCGA | 77 | 749 |
| 1063483 | N/A | N/A | 6018 | 6033 | AGCTGGAAGGACCGAG | 79 | 750 |
| 1063515 | N/A | N/A | 6161 | 6176 | ACAGAATGGGCTGGTG | 118 | 751 |
| 1063547 | N/A | N/A | 6367 | 6382 | GCTGTTTCAAGCCTCA | 67 | 752 |
| 1063579 | N/A | N/A | 6582 | 6597 | GGACATGTCCCGAGGG | 51 | 753 |
| 1063611 | N/A | N/A | 6987 | 7002 | AAAGGTCGGCACCTGT | 190 | 754 |
| 1063643 | N/A | N/A | 7196 | 7211 | GACACATAGCTATGCT | 116 | 755 |
| 1063675 | N/A | N/A | 7390 | 7405 | TTCAAATACTCTGCAC | 107 | 756 |
| 1063707 | N/A | N/A | 7870 | 7885 | AATAGCCTACACTGCT | 205 | 757 |
| 1063739 | N/A | N/A | 8010 | 8025 | GACTAGCTTTGTAAAG | 94 | 758 |
| 1063771 | N/A | N/A | 8106 | 8121 | CGAAAACCCTGACTCC | 147 | 759 |
| 1063802 | N/A | N/A | 8567 | 8582 | ATCTTACTACTTATTG | 93 | 760 |
| 1063834 | N/A | N/A | 8857 | 8872 | GCATGAGGAGTAGCAG | 85 | 761 |
| 1063866 | N/A | N/A | 9098 | 9113 | GTGCAAAGGCCTGGCT | 167 | 762 |
| 1063898 | N/A | N/A | 9507 | 9522 | TGGCATTACCTGCTGC | 128 | 763 |
| 1063930 | N/A | N/A | 9690 | 9705 | CAAACATGAGGCCTCA | 127 | 764 |
| 1063962 | N/A | N/A | 10301 | 10316 | GATCACAGTGTTTGGG | 30 | 765 |
| 1063994 | N/A | N/A | 10578 | 10593 | TAAACCCCCTGGCCT | 65 | 766 |
| 1064026 | N/A | N/A | 11119 | 11134 | CCAGAGGCTTAAACTT | 120 | 767 |
| 1064058 | N/A | N/A | 11448 | 11463 | GAGCGGATGCATTTTC | 69 | 768 |
| 1064090 | N/A | N/A | 11573 | 11588 | GTAGCTGGAGTCCAGA | 61 | 769 |

TABLE 14-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064124 | N/A | N/A | 11656 | 11671 | CCCGATTTTCCTTGGT | 154 | 770 |
| 1064156 | N/A | N/A | 11736 | 11751 | GTCAAGGTCTCTGATC | 100 | 771 |
| 1064188 | N/A | N/A | 11821 | 11836 | AATAGTTCTCCCCGAG | 95 | 772 |
| 1064220 | N/A | N/A | 11923 | 11938 | CCTGAGATCTCACCGT | 153 | 773 |
| 1064252 | N/A | N/A | 11991 | 12006 | AATCAAGCCCCATGCA | 133 | 774 |
| 1064284 | N/A | N/A | 12278 | 12293 | TGCGGACAGGTTTGGG | 30 | 775 |
| 1064316 | N/A | N/A | 12432 | 12447 | TTTAGGGCAAGGTGCA | 85 | 776 |
| 1064348 | N/A | N/A | 12587 | 12602 | AAGTTAAGGATCAAAT | 122 | 777 |
| 1064380 | N/A | N/A | 12789 | 12804 | GATTACAGAGTCAGCG | 102 | 778 |
| 1064412 | N/A | N/A | 12950 | 12965 | TTTAGGTCAGAAGCCA | 171 | 779 |
| 1064444 | N/A | N/A | 13224 | 13239 | ATTAGGTAAGGGATCA | 122 | 780 |

TABLE 15

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 9 | 65 |
| 1062012 | 10 | 25 | 410 | 425 | CAAATTTTTTTCGATG | 65 | 781 |
| 1062044 | 149 | 164 | 549 | 564 | TGGTGAAGTGGACTGA | 25 | 782 |
| 1062076 | 319 | 334 | 6857 | 6872 | TCTCGGCCCTGGAAGG | 89 | 783 |
| 1062108 | 464 | 479 | 7529 | 7544 | CTGGAGGAGTGCCTGT | 74 | 784 |
| 1062140 | 633 | 648 | N/A | N/A | TGATCCCAGGTGGGAG | 92 | 785 |
| 1062172 | 798 | 813 | 8444 | 8459 | CGAAGACCTTCTCACA | 106 | 786 |
| 1062204 | 901 | 916 | 9491 | 9506 | TCCAGAGACTGTACCA | 76 | 787 |
| 1062236 | 1102 | 1117 | 11258 | 11273 | CTCCGGACAGCAAACA | 92 | 788 |
| 1062268 | 1253 | 1268 | 13483 | 13498 | GAGTGTCCGCTGCTTC | 5* | 789 |
| 1062300 | 1453 | 1468 | 13863 | 13878 | GGGTTGGAACACCTGC | 85 | 790 |
| 1062332 | 1740 | 1755 | 14150 | 14165 | GCTGCAGGGCTCGACT | 60 | 791 |
| 1062364 | 1895 | 1910 | 14305 | 14320 | TGTACTGAGGCAGGCT | 42 | 792 |
| 1062396 | 2050 | 2065 | 14460 | 14475 | CGCTGCTTCTGTGTAG | 31 | 793 |
| 1062428 | 2269 | 2284 | N/A | N/A | CATGGATCAGGGCTCA | 28 | 794 |
| 1062460 | N/A | N/A | 8323 | 8338 | GCGAGGATCCTTCCCA | 73 | 795 |
| 1062492 | N/A | N/A | 13612 | 13627 | CCCACTTTGAGCTGCG | 55 | 796 |
| 1062524 | N/A | N/A | 557 | 572 | ACTCACCTTGGTGAAG | 112 | 797 |
| 1062556 | N/A | N/A | 691 | 706 | AAGACCTTACCTGGCT | 72 | 798 |
| 1062588 | N/A | N/A | 928 | 943 | CATCAAGAGCTAAGAG | 96 | 799 |
| 1062620 | N/A | N/A | 1115 | 1130 | GAAAGGAGATCGATGG | 72 | 800 |

TABLE 15-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062652 | N/A | N/A | 1265 | 1280 | TGAACAGAACTGATGC | 36 | 801 |
| 1062685 | N/A | N/A | 1350 | 1365 | AAGGGTCTCCTCTAAA | 62 | 802 |
| 1062717 | N/A | N/A | 1494 | 1509 | GCAGAATCGAGCTCAC | 53 | 803 |
| 1062749 | N/A | N/A | 1731 | 1746 | GTCCAACAATCGGCAC | 57 | 804 |
| 1062781 | N/A | N/A | 1895 | 1910 | AAGTAGAGGGAGCATA | 41 | 805 |
| 1062813 | N/A | N/A | 2081 | 2096 | GAACACCCTATTAGGA | 63 | 806 |
| 1062845 | N/A | N/A | 2255 | 2270 | ACCTATTTGACTGTAT | 56 | 807 |
| 1062877 | N/A | N/A | 2408 | 2423 | AGTACCCACACTCTTA | 52 | 808 |
| 1062909 | N/A | N/A | 2624 | 2639 | CTAATGCTGATCTTGG | 22 | 809 |
| 1062941 | N/A | N/A | 2741 | 2756 | TTATTGAGTGAATAGT | 54 | 810 |
| 1062973 | N/A | N/A | 2945 | 2960 | GAATTGTATTGCAAAG | 45 | 811 |
| 1063005 | N/A | N/A | 3145 | 3160 | GCGAGCAAGAGAGAAC | 58 | 812 |
| 1063037 | N/A | N/A | 3253 | 3268 | GGTTAAGTCATTAGGT | 19 | 813 |
| 1063069 | N/A | N/A | 3398 | 3413 | TAGAGTCCTGAGATCT | 95 | 814 |
| 1063101 | N/A | N/A | 3713 | 3728 | CACAATCAAGGTTTTC | 21 | 815 |
| 1063133 | N/A | N/A | 3946 | 3961 | TAGGGCCTCTTGCCTA | 110 | 816 |
| 1063165 | N/A | N/A | 4127 | 4142 | AATAGTATAACACCAG | 35 | 817 |
| 1063197 | N/A | N/A | 4249 | 4264 | CCACTATGACAAGCCC | 29 | 818 |
| 1063228 | N/A | N/A | 4438 | 4453 | ATTTTTCCGCCATTGA | 76 | 819 |
| 1063260 | N/A | N/A | 4608 | 4623 | GGACCTAGAGGGCCGG | 69 | 820 |
| 1063292 | N/A | N/A | 4722 | 4737 | GGACACTTGGCCAGAG | 53 | 821 |
| 1063324 | N/A | N/A | 5125 | 5140 | CGTGAGAAACAGGAGT | 20 | 822 |
| 1063356 | N/A | N/A | 5331 | 5346 | CCGTTCCACCTCACAG | 38 | 823 |
| 1063388 | N/A | N/A | 5527 | 5542 | CTATAATCCTGGTCTG | 64 | 824 |
| 1063420 | N/A | N/A | 5739 | 5754 | TCAGAGTTCACCCCAA | 48 | 825 |
| 1063452 | N/A | N/A | 5863 | 5878 | TCAGGGCAAGGAGGCG | 61 | 826 |
| 1063484 | N/A | N/A | 6019 | 6034 | CAGCTGGAAGGACCGA | 87 | 827 |
| 1063516 | N/A | N/A | 6162 | 6177 | CACAGAATGGGCTGGT | 46 | 828 |
| 1063548 | N/A | N/A | 6374 | 6389 | CTTGAGAGCTGTTTCA | 59 | 829 |
| 1063580 | N/A | N/A | 6584 | 6599 | TGGGACATGTCCCGAG | 59 | 830 |
| 1063612 | N/A | N/A | 6988 | 7003 | TAAAGGTCGGCACCTG | 84 | 831 |
| 1063644 | N/A | N/A | 7197 | 7212 | GGACACATAGCTATGC | 43 | 832 |
| 1063676 | N/A | N/A | 7424 | 7439 | GAGGCCATCCTGATCC | 52 | 833 |
| 1063708 | N/A | N/A | 7871 | 7886 | GAATAGCCTACACTGC | 75 | 834 |
| 1063740 | N/A | N/A | 8012 | 8027 | TTGACTAGCTTTGTAA | 34 | 835 |
| 1063772 | N/A | N/A | 8107 | 8122 | TCGAAAACCCTGACTC | 75 | 836 |
| 1063803 | N/A | N/A | 8580 | 8595 | GTTTAGCTCTTGCATC | 41 | 837 |
| 1063835 | N/A | N/A | 8860 | 8875 | TTGGCATGAGGAGTAG | 61 | 838 |

TABLE 15-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063867 | N/A | N/A | 9107 | 9122 | GGACGGCCTGTGCAAA | 81 | 839 |
| 1063899 | N/A | N/A | 9508 | 9523 | CTGGCATTACCTGCTG | 91 | 840 |
| 1063931 | N/A | N/A | 9691 | 9706 | ACAAACATGAGGCCTC | 74 | 841 |
| 1063963 | N/A | N/A | 10305 | 10320 | TCAGGATCACAGTGTT | 19 | 842 |
| 1063995 | N/A | N/A | 10579 | 10594 | CTAAACCCCCTGGCC | 71 | 843 |
| 1064027 | N/A | N/A | 11120 | 11135 | CCCAGAGGCTTAAACT | 87 | 844 |
| 1064059 | N/A | N/A | 11449 | 11464 | TGAGCGGATGCATTTT | 59 | 845 |
| 1064091 | N/A | N/A | 11575 | 11590 | TAGTAGCTGGAGTCCA | 16 | 846 |
| 1064125 | N/A | N/A | 11657 | 11672 | CCCCGATTTTCCTTGG | 32 | 847 |
| 1064157 | N/A | N/A | 11737 | 11752 | AGTCAAGGTCTCTGAT | 75 | 848 |
| 1064189 | N/A | N/A | 11822 | 11837 | AAATAGTTCTCCCCGA | 42 | 849 |
| 1064221 | N/A | N/A | 11924 | 11939 | GCCTGAGATCTCACCG | 42 | 850 |
| 1064253 | N/A | N/A | 11992 | 12007 | GAATCAAGCCCCATGC | 75 | 851 |
| 1064285 | N/A | N/A | 12282 | 12297 | GATTTGCGGACAGGTT | 67 | 852 |
| 1064317 | N/A | N/A | 12433 | 12448 | GTTTAGGGCAAGGTGC | 77 | 853 |
| 1064349 | N/A | N/A | 12589 | 12604 | TGAAGTTAAGGATCAA | 69 | 854 |
| 1064381 | N/A | N/A | 12793 | 12808 | ATGGGATTACAGAGTC | 40 | 855 |
| 1064413 | N/A | N/A | 12951 | 12966 | CTTTAGGTCAGAAGCC | 72 | 856 |
| 1064445 | N/A | N/A | 13225 | 13240 | GATTAGGTAAGGGATC | 104 | 857 |

TABLE 16

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 29 | 65 |
| 1062007 | 3 | 18 | 403 | 418 | TTTTCGATGAGTGTGT | 12 | 858 |
| 1062039 | 121 | 136 | 521 | 536 | AGCCTGGCTTGTGGGA | 68 | 859 |
| 1062071 | 312 | 327 | 6850 | 6865 | CCTGGAAGGTTCCCCC | 65 | 860 |
| 1062103 | 425 | 440 | 7490 | 7505 | TGCCCCGGAGGGTGCC | 87 | 861 |
| 1062135 | 596 | 611 | 7759 | 7774 | GAAGACCCCAGTGGCG | 47 | 862 |
| 1062167 | 762 | 777 | 8408 | 8423 | CATTTGCCAGCAGTGG | 76 | 863 |
| 1062199 | 877 | 892 | 9467 | 9482 | TGGAGGAGACATTGTG | 63 | 864 |
| 1062231 | 1060 | 1075 | 11216 | 11231 | GACCAGGCTGGGACGA | 42 | 865 |
| 1062263 | 1184 | 1199 | 12054 | 12069 | TCGCATGTTGTGGAAC | 2* | 866 |
| 1062295 | 1428 | 1443 | 13838 | 13853 | GGCTCCGTTTCTTGCG | 214 | 867 |
| 1062327 | 1594 | 1609 | 14004 | 14019 | ACAGTGGAAACCTCAC | 48 | 868 |
| 1062359 | 1853 | 1868 | 14263 | 14278 | TGAGGGACAGGATTGT | 75 | 869 |

TABLE 16-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062391 | 2037 | 2052 | 14447 | 14462 | TAGGCCTCTGGGCACA | 67 | 870 |
| 1062423 | 2211 | 2226 | 14621 | 14636 | TTTTGGCAAGGCAGTG | 54 | 871 |
| 1062455 | N/A | N/A | 8300 | 8315 | CCACTGACCTGTCCTT | 114 | 872 |
| 1062487 | N/A | N/A | 13602 | 13617 | GCTGCGATGGCACTTG | 74 | 873 |
| 1062551 | N/A | N/A | 686 | 701 | CTTACCTGGCTGGAAT | 78 | 874 |
| 1062583 | N/A | N/A | 868 | 883 | GGACAGCATTTCAAGT | 60 | 875 |
| 1062615 | N/A | N/A | 1110 | 1125 | GAGATCGATGGAGTGT | 61 | 876 |
| 1062647 | N/A | N/A | 1251 | 1266 | GCTCACTCTCATAAAA | 67 | 877 |
| 1062680 | N/A | N/A | 1339 | 1354 | CTAAAGCGATACAAGC | 43 | 878 |
| 1062712 | N/A | N/A | 1489 | 1504 | ATCGAGCTCACCCCAG | 11 | 879 |
| 1062744 | N/A | N/A | 1725 | 1740 | CAATCGGCACTTGGTC | 46 | 880 |
| 1062776 | N/A | N/A | 1879 | 1894 | AAATAGGACAACCTTT | 74 | 881 |
| 1062808 | N/A | N/A | 2076 | 2091 | CCCTATTAGGAGTAAG | 58 | 882 |
| 1062840 | N/A | N/A | 2162 | 2177 | CTATATATGTAATGGC | 14 | 883 |
| 1062872 | N/A | N/A | 2395 | 2410 | TTAACCTCTATAGTAA | 58 | 884 |
| 1062904 | N/A | N/A | 2615 | 2630 | ATCTTGGGTTTATTGT | 21 | 885 |
| 1062936 | N/A | N/A | 2733 | 2748 | TGAATAGTCAGTCCAT | 34 | 886 |
| 1062968 | N/A | N/A | 2873 | 2888 | CAGAATAGAAAGCTTG | 60 | 887 |
| 1063000 | N/A | N/A | 3088 | 3103 | GGAGAGCCAGAGTGCA | 81 | 888 |
| 1063032 | N/A | N/A | 3247 | 3262 | GTCATTAGGTGTCTGC | 3 | 889 |
| 1063064 | N/A | N/A | 3391 | 3406 | CTGAGATCTAGGCTTG | 46 | 890 |
| 1063096 | N/A | N/A | 3645 | 3660 | CATCATCACCACGCTC | 60 | 891 |
| 1063128 | N/A | N/A | 3865 | 3880 | TCCCAAATACATGGCC | 70 | 892 |
| 1063160 | N/A | N/A | 4122 | 4137 | TATAACACCAGGACCT | 66 | 893 |
| 1063192 | N/A | N/A | 4235 | 4250 | CCCTAGCTCTGAAGAC | 71 | 894 |
| 1063224 | N/A | N/A | 4412 | 4427 | GCCGGATGCGCCGGGC | 84 | 895 |
| 1063255 | N/A | N/A | 4582 | 4597 | CGGCTTCCTGCACTGT | 85 | 896 |
| 1063287 | N/A | N/A | 4713 | 4728 | GCCAGAGCTAAGAATT | 64 | 897 |
| 1063319 | N/A | N/A | 5093 | 5108 | TCCGAACAAGGGCCTG | 25 | 898 |
| 1063351 | N/A | N/A | 5277 | 5292 | GGAGTATAGAAGGGTT | 35 | 899 |
| 1063383 | N/A | N/A | 5497 | 5512 | CTGGAAGGGACTGCCC | 67 | 900 |
| 1063415 | N/A | N/A | 5685 | 5700 | CCTCAAATGCCCACTC | 65 | 901 |
| 1063447 | N/A | N/A | 5857 | 5872 | CAAGGAGGCGAGTCCA | 74 | 902 |
| 1063479 | N/A | N/A | 6014 | 6029 | GGAAGGACCGAGCTGA | 40 | 903 |
| 1063511 | N/A | N/A | 6136 | 6151 | AAGGCGAGAAGTGGGT | 24 | 904 |
| 1063543 | N/A | N/A | 6290 | 6305 | TCGGACTTTCTCCTCG | 45 | 905 |
| 1063575 | N/A | N/A | 6466 | 6481 | GCAGAGGTCCAGCACC | 70 | 906 |
| 1063607 | N/A | N/A | 6982 | 6997 | TCGGCACCTGTAGGTC | 87 | 907 |

TABLE 16-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063639 | N/A | N/A | 7173 | 7188 | CTACAATACGGCCTCC | 62 | 908 |
| 1063671 | N/A | N/A | 7378 | 7393 | GCACTGCAAGCCCACA | 40 | 909 |
| 1063703 | N/A | N/A | 7804 | 7819 | GGCTGAGGTGTTACCA | 46 | 910 |
| 1063735 | N/A | N/A | 8000 | 8015 | GTAAAGCTCTGTGGTT | 19 | 911 |
| 1063767 | N/A | N/A | 8047 | 8062 | AAGCTTAAAGACGGCC | 59 | 912 |
| 1063798 | N/A | N/A | 8562 | 8577 | ACTACTTATTGGGATG | 90 | 913 |
| 1063830 | N/A | N/A | 8851 | 8866 | GGAGTAGCAGGGCAAA | 50 | 914 |
| 1063862 | N/A | N/A | 9053 | 9068 | GCTAAGGGTTGTGTGT | 58 | 915 |
| 1063894 | N/A | N/A | 9417 | 9432 | GCAGTGCCTAAGTAGG | 87 | 916 |
| 1063926 | N/A | N/A | 9685 | 9700 | ATGAGGCCTCAGCCTG | 100 | 917 |
| 1063958 | N/A | N/A | 9962 | 9977 | TCAGAGGGTTTGTAAG | 49 | 918 |
| 1063990 | N/A | N/A | 10542 | 10557 | TTCGCATCATGAGAAA | 101 | 919 |
| 1064022 | N/A | N/A | 11114 | 11129 | GGCTTAAACTTCCCAC | 91 | 920 |
| 1064054 | N/A | N/A | 11382 | 11397 | AGCATGGAGCTCCTTT | 38 | 921 |
| 1064086 | N/A | N/A | 11552 | 11567 | TGAGGCATGGCCCCAA | 106 | 922 |
| 1064120 | N/A | N/A | 11652 | 11667 | ATTTTCCTTGGTCAGG | 30 | 923 |
| 1064152 | N/A | N/A | 11727 | 11742 | TCTGATCCCTGCTAAG | 74 | 924 |
| 1064184 | N/A | N/A | 11805 | 11820 | GTTGAAAAGAAGCGGA | 30 | 925 |
| 1064216 | N/A | N/A | 11916 | 11931 | TCTCACCGTCAACACC | 81 | 926 |
| 1064248 | N/A | N/A | 11981 | 11996 | CATGCAGGACCTCCTA | 59 | 927 |
| 1064280 | N/A | N/A | 12201 | 12216 | TGGGAATGGAGGAACC | 68 | 928 |
| 1064312 | N/A | N/A | 12394 | 12409 | ATTTTATGGGTCCAGG | 27 | 929 |
| 1064344 | N/A | N/A | 12582 | 12597 | AAGGATCAAATGGGTG | 70 | 930 |
| 1064376 | N/A | N/A | 12785 | 12800 | ACAGAGTCAGCGATGA | 75 | 931 |
| 1064408 | N/A | N/A | 12926 | 12941 | TTGAATTATCGAGTAT | 83 | 932 |
| 1064440 | N/A | N/A | 13220 | 13235 | GGTAAGGGATCAGGAC | 70 | 933 |

TABLE 17

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910956 | 1800 | 1815 | 14210 | 14225 | AGTAATCTGTGCGAGC | 18 | 250 |
| 911144 | N/A | N/A | 7355 | 7370 | TGCTATGATCATCCCC | 35 | 65 |
| 1062013 | 13 | 28 | 413 | 428 | ATCCAAATTTTTTCG | 83 | 934 |
| 1062045 | 150 | 165 | 550 | 565 | TTGGTGAAGTGGACTG | 84 | 935 |
| 1062077 | 320 | 335 | 6858 | 6873 | ATCTCGGCCCTGGAAG | 114 | 936 |
| 1062109 | 466 | 481 | 7531 | 7546 | TCCTGGAGGAGTGCCT | 91 | 937 |

TABLE 17-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062141 | 635 | 650 | N/A | N/A | GTTGATCCCAGGTGGG | 45 | 938 |
| 1062173 | 799 | 814 | 8445 | 8460 | TCGAAGACCTTCTCAC | 105 | 939 |
| 1062205 | 945 | 960 | 9740 | 9755 | CCTGCATGGCACTCAG | 104 | 940 |
| 1062237 | 1103 | 1118 | 11259 | 11274 | CCTCCGGACAGCAAAC | 133 | 941 |
| 1062269 | 1256 | 1271 | 13486 | 13501 | ATTGAGTGTCCGCTGC | 34* | 942 |
| 1062301 | 1454 | 1469 | 13864 | 13879 | AGGGTTGGAACACCTG | 160 | 943 |
| 1062333 | 1742 | 1757 | 14152 | 14167 | TGGCTGCAGGGCTCGA | 57 | 944 |
| 1062365 | 1897 | 1912 | 14307 | 14322 | AGTGTACTGAGGCAGG | 25 | 945 |
| 1062397 | 2063 | 2078 | 14473 | 14488 | CTGAGGGTACTGACGC | 13 | 946 |
| 1062429 | 2270 | 2285 | N/A | N/A | GCATGGATCAGGGCTC | 69 | 947 |
| 1062461 | N/A | N/A | 8324 | 8339 | GGCGAGGATCCTTCCC | 117 | 948 |
| 1062493 | N/A | N/A | 13613 | 13628 | GCCCACTTTGAGCTGC | 122 | 949 |
| 1062525 | N/A | N/A | 559 | 574 | ACACTCACCTTGGTGA | 152 | 950 |
| 1062557 | N/A | N/A | 692 | 707 | AAAGACCTTACCTGGC | 41 | 951 |
| 1062589 | N/A | N/A | 929 | 944 | GCATCAAGAGCTAAGA | 109 | 952 |
| 1062621 | N/A | N/A | 1116 | 1131 | GGAAAGGAGATCGATG | 120 | 953 |
| 1062653 | N/A | N/A | 1267 | 1282 | GGTGAACAGAACTGAT | 77 | 954 |
| 1062686 | N/A | N/A | 1351 | 1366 | CAAGGGTCTCCTCTAA | 114 | 955 |
| 1062718 | N/A | N/A | 1496 | 1511 | CTGCAGAATCGAGCTC | 54 | 956 |
| 1062750 | N/A | N/A | 1747 | 1762 | GAGAAACAACCGGAAT | 91 | 957 |
| 1062782 | N/A | N/A | 1896 | 1911 | TAAGTAGAGGGAGCAT | 39 | 958 |
| 1062814 | N/A | N/A | 2083 | 2098 | ATGAACACCCTATTAG | 96 | 959 |
| 1062846 | N/A | N/A | 2256 | 2271 | AACCTATTTGACTGTA | 93 | 960 |
| 1062878 | N/A | N/A | 2409 | 2424 | CAGTACCCACACTCTT | 100 | 961 |
| 1062910 | N/A | N/A | 2625 | 2640 | CCTAATGCTGATCTTG | 72 | 962 |
| 1062942 | N/A | N/A | 2742 | 2757 | GTTATTGAGTGAATAG | 74 | 963 |
| 1062974 | N/A | N/A | 2952 | 2967 | GGGTATTGAATTGTAT | 69 | 964 |
| 1063006 | N/A | N/A | 3151 | 3166 | CAAAGAGCGAGCAAGA | 85 | 965 |
| 1063038 | N/A | N/A | 3254 | 3269 | TGGTTAAGTCATTAGG | 6 | 966 |
| 1063070 | N/A | N/A | 3399 | 3414 | CTAGAGTCCTGAGATC | 82 | 967 |
| 1063102 | N/A | N/A | 3714 | 3729 | CCACAATCAAGGTTTT | 47 | 968 |
| 1063134 | N/A | N/A | 3947 | 3962 | ATAGGGCCTCTTGCCT | 117 | 969 |
| 1063166 | N/A | N/A | 4129 | 4144 | CAAATAGTATAACACC | 101 | 970 |
| 1063198 | N/A | N/A | 4338 | 4353 | CCGAGAACTGGCTGCC | 51 | 971 |
| 1063229 | N/A | N/A | 4439 | 4454 | GATTTTTCCGCCATTG | 120 | 972 |
| 1063261 | N/A | N/A | 4610 | 4625 | GAGGACCTAGAGGGCC | 100 | 973 |
| 1063293 | N/A | N/A | 4725 | 4740 | CCTGGACACTTGGCCA | 142 | 974 |
| 1063325 | N/A | N/A | 5139 | 5154 | TTAGAACATTACTGCG | 46 | 975 |

TABLE 17-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063357 | N/A | N/A | 5370 | 5385 | TAAACTCTCTGGTGTG | 88 | 976 |
| 1063389 | N/A | N/A | 5528 | 5543 | CCTATAATCCTGGTCT | 43 | 977 |
| 1063421 | N/A | N/A | 5744 | 5759 | CCCCATCAGAGTTCAC | 59 | 978 |
| 1063453 | N/A | N/A | 5870 | 5885 | CTGGATCTCAGGGCAA | 93 | 979 |
| 1063485 | N/A | N/A | 6020 | 6035 | GCAGCTGGAAGGACCG | 78 | 980 |
| 1063517 | N/A | N/A | 6192 | 6207 | TGTAACAGTCCTGGCA | 118 | 981 |
| 1063549 | N/A | N/A | 6377 | 6392 | CCACTTGAGAGCTGTT | 46 | 982 |
| 1063581 | N/A | N/A | 6585 | 6600 | CTGGGACATGTCCCGA | 159 | 983 |
| 1063613 | N/A | N/A | 6989 | 7004 | GTAAAGGTCGGCACCT | 113 | 984 |
| 1063645 | N/A | N/A | 7240 | 7255 | ACCTACTTGGCCCCAG | 67 | 985 |
| 1063677 | N/A | N/A | 7427 | 7442 | TGAGAGGCCATCCTGA | 93 | 986 |
| 1063709 | N/A | N/A | 7872 | 7887 | AGAATAGCCTACACTG | 88 | 987 |
| 1063741 | N/A | N/A | 8013 | 8028 | TTTGACTAGCTTTGTA | 65 | 988 |
| 1063773 | N/A | N/A | 8109 | 8124 | CCTCGAAAACCCTGAC | 39 | 989 |
| 1063804 | N/A | N/A | 8582 | 8597 | GAGTTTAGCTCTTGCA | 20 | 990 |
| 1063836 | N/A | N/A | 8863 | 8878 | ATGTTGGCATGAGGAG | 70 | 991 |
| 1063868 | N/A | N/A | 9108 | 9123 | GGGACGGCCTGTGCAA | 104 | 992 |
| 1063900 | N/A | N/A | 9524 | 9539 | CTTACCCTCCACCGCC | 83 | 993 |
| 1063932 | N/A | N/A | 9692 | 9707 | CACAAACATGAGGCCT | 45 | 994 |
| 1063964 | N/A | N/A | 10306 | 10321 | CTCAGGATCACAGTGT | 47 | 995 |
| 1063996 | N/A | N/A | 10580 | 10595 | CCTAAACCCCCTGGC | 124 | 996 |
| 1064028 | N/A | N/A | 11121 | 11136 | ACCCAGAGGCTTAAAC | 111 | 997 |
| 1064060 | N/A | N/A | 11450 | 11465 | GTGAGCGGATGCATTT | 60 | 998 |
| 1064092 | N/A | N/A | 11577 | 11592 | TATAGTAGCTGGAGTC | 65 | 999 |
| 1064126 | N/A | N/A | 11658 | 11673 | ACCCCGATTTTCCTTG | 74 | 1000 |
| 1064158 | N/A | N/A | 11741 | 11756 | TGACAGTCAAGGTCTC | 113 | 1001 |
| 1064190 | N/A | N/A | 11823 | 11838 | AAAATAGTTCTCCCCG | 41 | 1002 |
| 1064222 | N/A | N/A | 11926 | 11941 | AGGCCTGAGATCTCAC | 70 | 1003 |
| 1064254 | N/A | N/A | 11993 | 12008 | TGAATCAAGCCCCATG | 125 | 1004 |
| 1064286 | N/A | N/A | 12283 | 12298 | GGATTTGCGGACAGGT | 16 | 1005 |
| 1064318 | N/A | N/A | 12434 | 12449 | CGTTTAGGGCAAGGTG | 97 | 1006 |
| 1064350 | N/A | N/A | 12616 | 12631 | TGAGATGAAGGAGTTG | 142 | 1007 |
| 1064382 | N/A | N/A | 12795 | 12810 | GAATGGGATTACAGAG | 92 | 1008 |
| 1064414 | N/A | N/A | 12952 | 12967 | GCTTTAGGTCAGAAGC | 105 | 1009 |
| 1064446 | N/A | N/A | 13226 | 13241 | GGATTAGGTAAGGGAT | 105 | 1010 |

TABLE 18

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910956 | 1800 | 1815 | 14210 | 14225 | AGTAATCTGTGCGAGC | 18 | 250 |
| 911144 | N/A | N/A | 7355 | 7370 | TGCTATGATCATCCCC | 42 | 65 |
| 1062014 | 35 | 50 | 435 | 450 | CGCAGACCTCTCTCTT | 57 | 1011 |
| 1062046 | 151 | 166 | 551 | 566 | CTTGGTGAAGTGGACT | 67 | 1012 |
| 1062078 | 321 | 336 | 6859 | 6874 | GATCTCGGCCCTGGAA | 33 | 1013 |
| 1062110 | 467 | 482 | 7532 | 7547 | GTCCTGGAGGAGTGCC | 69 | 1014 |
| 1062142 | 658 | 673 | 8235 | 8250 | GACACCCATTCCAGGC | 78 | 1015 |
| 1062174 | 800 | 815 | 8446 | 8461 | TTCGAAGACCTTCTCA | 131 | 1016 |
| 1062206 | 979 | 994 | 9774 | 9789 | GCCTTGGTCAGTGCCA | 36 | 1017 |
| 1062238 | 1104 | 1119 | 11260 | 11275 | GCCTCCGGACAGCAAA | 98 | 1018 |
| 1062270 | 1258 | 1273 | 13488 | 13503 | TCATTGAGTGTCCGCT | 75* | 1019 |
| 1062302 | 1455 | 1470 | 13865 | 13880 | TAGGGTTGGAACACCT | 82 | 1020 |
| 1062334 | 1743 | 1758 | 14153 | 14168 | TTGGCTGCAGGGCTCG | 30 | 1021 |
| 1062366 | 1898 | 1913 | 14308 | 14323 | GAGTGTACTGAGGCAG | 12 | 1022 |
| 1062398 | 2064 | 2079 | 14474 | 14489 | CCTGAGGGTACTGACG | 49 | 1023 |
| 1062430 | 2271 | 2286 | N/A | N/A | GGCATGGATCAGGGCT | 75 | 1024 |
| 1062462 | N/A | N/A | 8325 | 8340 | GGGCGAGGATCCTTCC | 53 | 1025 |
| 1062494 | N/A | N/A | 13634 | 13649 | TATGAGCCCAGACCCA | 95 | 1026 |
| 1062526 | N/A | N/A | 560 | 575 | GACACTCACCTTGGTG | 96 | 1027 |
| 1062558 | N/A | N/A | 693 | 708 | TAAAGACCTTACCTGG | 87 | 1028 |
| 1062590 | N/A | N/A | 931 | 946 | AGGCATCAAGAGCTAA | 107 | 1029 |
| 1062622 | N/A | N/A | 1117 | 1132 | AGGAAAGGAGATCGAT | 107 | 1030 |
| 1062654 | N/A | N/A | 1268 | 1283 | GGGTGAACAGAACTGA | 56 | 1031 |
| 1062687 | N/A | N/A | 1352 | 1367 | CCAAGGGTCTCCTCTA | 95 | 1032 |
| 1062719 | N/A | N/A | 1497 | 1512 | CCTGCAGAATCGAGCT | 68 | 1033 |
| 1062751 | N/A | N/A | 1748 | 1763 | CGAGAAACAACCGGAA | 69 | 1034 |
| 1062783 | N/A | N/A | 1897 | 1912 | TTAAGTAGAGGGAGCA | 25 | 1035 |
| 1062815 | N/A | N/A | 2084 | 2099 | GATGAACACCCTATTA | 126 | 1036 |
| 1062847 | N/A | N/A | 2258 | 2273 | CTAACCTATTTGACTG | 70 | 1037 |
| 1062879 | N/A | N/A | 2410 | 2425 | CCAGTACCCACACTCT | 85 | 1038 |
| 1062911 | N/A | N/A | 2626 | 2641 | ACCTAATGCTGATCTT | 72 | 1039 |
| 1062943 | N/A | N/A | 2748 | 2763 | GATAAAGTTATTGAGT | 79 | 1040 |
| 1062975 | N/A | N/A | 2953 | 2968 | TGGGTATTGAATTGTA | 43 | 1041 |
| 1063007 | N/A | N/A | 3152 | 3167 | ACAAAGAGCGAGCAAG | 136 | 1042 |
| 1063039 | N/A | N/A | 3255 | 3270 | CTGGTTAAGTCATTAG | 26 | 1043 |
| 1063071 | N/A | N/A | 3401 | 3416 | ACCTAGAGTCCTGAGA | 132 | 1044 |
| 1063103 | N/A | N/A | 3716 | 3731 | CCCCACAATCAAGGTT | 78 | 1045 |
| 1063135 | N/A | N/A | 3949 | 3964 | TCATAGGGCCTCTTGC | 92 | 1046 |

TABLE 18-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063167 | N/A | N/A | 4132 | 4147 | CTTCAAATAGTATAAC | 101 | 1047 |
| 1063199 | N/A | N/A | 4339 | 4354 | TCCGAGAACTGGCTGC | 62 | 1048 |
| 1063230 | N/A | N/A | 4440 | 4455 | AGATTTTTCCGCCATT | 102 | 1049 |
| 1063262 | N/A | N/A | 4611 | 4626 | AGAGGACCTAGAGGGC | 66 | 1050 |
| 1063294 | N/A | N/A | 4726 | 4741 | GCCTGGACACTTGGCC | 41 | 1051 |
| 1063326 | N/A | N/A | 5140 | 5155 | CTTAGAACATTACTGC | 33 | 1052 |
| 1063358 | N/A | N/A | 5398 | 5413 | TAGGAAGTGTTTCCGT | 82 | 1053 |
| 1063390 | N/A | N/A | 5529 | 5544 | TCCTATAATCCTGGTC | 103 | 1054 |
| 1063422 | N/A | N/A | 5765 | 5780 | GTAGAAGCTTCTCTAC | 100 | 1055 |
| 1063454 | N/A | N/A | 5923 | 5938 | CTGGCATTAAATATGT | 94 | 1056 |
| 1063486 | N/A | N/A | 6030 | 6045 | TTTAGCTTGAGCAGCT | 100 | 1057 |
| 1063518 | N/A | N/A | 6193 | 6208 | TTGTAACAGTCCTGGC | 44 | 1058 |
| 1063550 | N/A | N/A | 6378 | 6393 | TCCACTTGAGAGCTGT | 52 | 1059 |
| 1063582 | N/A | N/A | 6586 | 6601 | GCTGGGACATGTCCCG | 84 | 1060 |
| 1063614 | N/A | N/A | 6990 | 7005 | AGTAAAGGTCGGCACC | 98 | 1061 |
| 1063646 | N/A | N/A | 7244 | 7259 | CCTCACCTACTTGGCC | 32 | 1062 |
| 1063678 | N/A | N/A | 7428 | 7443 | GTGAGAGGCCATCCTG | 85 | 1063 |
| 1063710 | N/A | N/A | 7873 | 7888 | CAGAATAGCCTACACT | 85 | 1064 |
| 1063742 | N/A | N/A | 8015 | 8030 | ATTTTGACTAGCTTTG | 53 | 1065 |
| 1063774 | N/A | N/A | 8110 | 8125 | GCCTCGAAAACCCTGA | 30 | 1066 |
| 1063805 | N/A | N/A | 8587 | 8602 | TCTCAGAGTTTAGCTC | 60 | 1067 |
| 1063837 | N/A | N/A | 8864 | 8879 | CATGTTGGCATGAGGA | 40 | 1068 |
| 1063869 | N/A | N/A | 9110 | 9125 | GAGGGACGGCCTGTGC | 108 | 1069 |
| 1063901 | N/A | N/A | 9525 | 9540 | CCTTACCCTCCACCGC | 35 | 1070 |
| 1063933 | N/A | N/A | 9693 | 9708 | GCACAAACATGAGGCC | 111 | 1071 |
| 1063965 | N/A | N/A | 10307 | 10322 | ACTCAGGATCACAGTG | 77 | 1072 |
| 1063997 | N/A | N/A | 10581 | 10596 | ACCTAAACCCCCCTGG | 75 | 1073 |
| 1064029 | N/A | N/A | 11124 | 11139 | GTGACCCAGAGGCTTA | 105 | 1074 |
| 1064061 | N/A | N/A | 11451 | 11466 | TGTGAGCGGATGCATT | 80 | 1075 |
| 1064093 | N/A | N/A | 11578 | 11593 | ATATAGTAGCTGGAGT | 71 | 1076 |
| 1064127 | N/A | N/A | 11659 | 11674 | CACCCCGATTTTCCTT | 66 | 1077 |
| 1064159 | N/A | N/A | 11743 | 11758 | GATGACAGTCAAGGTC | 70 | 1078 |
| 1064191 | N/A | N/A | 11824 | 11839 | CAAAATAGTTCTCCCC | 30 | 1079 |
| 1064223 | N/A | N/A | 11929 | 11944 | TACAGGCCTGAGATCT | 69 | 1080 |
| 1064255 | N/A | N/A | 11995 | 12010 | GATGAATCAAGCCCCA | 55 | 1081 |
| 1064287 | N/A | N/A | 12296 | 12311 | GTGGTTTAGGTTTGGA | 13 | 1082 |
| 1064319 | N/A | N/A | 12453 | 12468 | TAGAGTAAGAGCTGGG | 64 | 1083 |

TABLE 18-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064351 | N/A | N/A | 12638 | 12653 | TCTGAGAAGGCATTGG | 73 | 1084 |
| 1064383 | N/A | N/A | 12809 | 12824 | CAGTTTGGATTCAGGA | 55 | 1085 |
| 1064415 | N/A | N/A | 12953 | 12968 | GGCTTTAGGTCAGAAG | 133 | 1086 |
| 1064447 | N/A | N/A | 13229 | 13244 | CTGGGATTAGGTAAGG | 110 | 1087 |

TABLE 19

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910956 | 1800 | 1815 | 14210 | 14225 | AGTAATCTGTGCGAGC | 33 | 250 |
| 911144 | N/A | N/A | 7355 | 7370 | TGCTATGATCATCCCC | 36 | 65 |
| 1062015 | 37 | 52 | 437 | 452 | GCCGCAGACCTCTCTC | 32 | 1088 |
| 1062047 | 153 | 168 | N/A | N/A | GGCTTGGTGAAGTGGA | 48 | 1089 |
| 1062079 | 322 | 337 | 6860 | 6875 | AGATCTCGGCCCTGGA | 122 | 1090 |
| 1062111 | 483 | 498 | 7548 | 7563 | GCATGAAATGTGGCCT | 120 | 1091 |
| 1062143 | 661 | 676 | 8238 | 8253 | CTGGACACCCATTCCA | 126 | 1092 |
| 1062175 | 801 | 816 | 8447 | 8462 | CTTCGAAGACCTTCTC | 103 | 1093 |
| 1062207 | 980 | 995 | 9775 | 9790 | AGCCTTGGTCAGTGCC | 125 | 1094 |
| 1062239 | 1111 | 1126 | 11267 | 11282 | CACAGGTGCCTCCGGA | 165 | 1095 |
| 1062271 | 1259 | 1274 | 13489 | 13504 | CTCATTGAGTGTCCGC | 79* | 1096 |
| 1062303 | 1456 | 1471 | 13866 | 13881 | GTAGGGTTGGAACACC | 140 | 1097 |
| 1062335 | 1744 | 1759 | 14154 | 14169 | TTTGGCTGCAGGGCTC | 35 | 1098 |
| 1062367 | 1899 | 1914 | 14309 | 14324 | TGAGTGTACTGAGGCA | 31 | 1099 |
| 1062399 | 2065 | 2080 | 14475 | 14490 | TCCTGAGGGTACTGAC | 108 | 1100 |
| 1062431 | 2273 | 2288 | N/A | N/A | GAGGCATGGATCAGGG | 42 | 1101 |
| 1062463 | N/A | N/A | 8326 | 8341 | AGGGCGAGGATCCTTC | 106 | 1102 |
| 1062495 | N/A | N/A | 13636 | 13651 | CCTATGAGCCCAGACC | 144 | 1103 |
| 1062527 | N/A | N/A | 561 | 576 | GGACACTCACCTTGGT | 113 | 1104 |
| 1062559 | N/A | N/A | 694 | 709 | TTAAAGACCTTACCTG | 116 | 1105 |
| 1062591 | N/A | N/A | 932 | 947 | GAGGCATCAAGAGCTA | 90 | 1106 |
| 1062623 | N/A | N/A | 1119 | 1134 | GGAGGAAAGGAGATCG | 149 | 1107 |
| 1062655 | N/A | N/A | 1271 | 1286 | CTAGGGTGAACAGAAC | 55 | 1108 |
| 1062688 | N/A | N/A | 1358 | 1373 | CCCGCCCCAAGGGTCT | 56 | 1109 |
| 1062720 | N/A | N/A | 1503 | 1518 | GCTAAGCCTGCAGAAT | 96 | 1110 |
| 1062752 | N/A | N/A | 1749 | 1764 | ACGAGAAACAACCGGA | 130 | 1111 |
| 1062784 | N/A | N/A | 1907 | 1922 | TAGGGTTAGCTTAAGT | 46 | 1112 |
| 1062816 | N/A | N/A | 2085 | 2100 | AGATGAACACCCTATT | 72 | 1113 |
| 1062848 | N/A | N/A | 2259 | 2274 | ACTAACCTATTTGACT | 89 | 1114 |

TABLE 19-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062880 | N/A | N/A | 2411 | 2426 | TCCAGTACCCACACTC | 83 | 1115 |
| 1062912 | N/A | N/A | 2627 | 2642 | CACCTAATGCTGATCT | 63 | 1116 |
| 1062944 | N/A | N/A | 2761 | 2776 | TAATTAGGGAGAAGAT | 101 | 1117 |
| 1062976 | N/A | N/A | 2954 | 2969 | CTGGGTATTGAATTGT | 57 | 1118 |
| 1063008 | N/A | N/A | 3153 | 3168 | CACAAAGAGCGAGCAA | 108 | 1119 |
| 1063040 | N/A | N/A | 3256 | 3271 | TCTGGTTAAGTCATTA | 76 | 1120 |
| 1063072 | N/A | N/A | 3402 | 3417 | CACCTAGAGTCCTGAG | 130 | 1121 |
| 1063104 | N/A | N/A | 3739 | 3754 | CATCATCAGACTCTCT | 114 | 1122 |
| 1063136 | N/A | N/A | 3950 | 3965 | TTCATAGGGCCTCTTG | 74 | 1123 |
| 1063168 | N/A | N/A | 4151 | 4166 | ATACTGGGACCCCTGG | 123 | 1124 |
| 1063200 | N/A | N/A | 4340 | 4355 | TTCCGAGAACTGGCTG | 48 | 1125 |
| 1063231 | N/A | N/A | 4441 | 4456 | CAGATTTTCCGCCAT | 84 | 1126 |
| 1063263 | N/A | N/A | 4613 | 4628 | GTAGAGGACCTAGAGG | 50 | 1127 |
| 1063295 | N/A | N/A | 4742 | 4757 | GGTCACTTCTGAAGCT | 71 | 1128 |
| 1063327 | N/A | N/A | 5142 | 5157 | GGCTTAGAACATTACT | 98 | 1129 |
| 1063359 | N/A | N/A | 5399 | 5414 | TTAGGAAGTGTTTCCG | 109 | 1130 |
| 1063391 | N/A | N/A | 5530 | 5545 | ATCCTATAATCCTGGT | 128 | 1131 |
| 1063423 | N/A | N/A | 5768 | 5783 | CCTGTAGAAGCTTCTC | 82 | 1132 |
| 1063455 | N/A | N/A | 5930 | 5945 | GAAGAGTCTGGCATTA | 73 | 1133 |
| 1063487 | N/A | N/A | 6031 | 6046 | TTTTAGCTTGAGCAGC | 174 | 1134 |
| 1063519 | N/A | N/A | 6194 | 6209 | ATTGTAACAGTCCTGG | 54 | 1135 |
| 1063551 | N/A | N/A | 6379 | 6394 | CTCCACTTGAGAGCTG | 81 | 1136 |
| 1063583 | N/A | N/A | 6587 | 6602 | GGCTGGGACATGTCCC | 147 | 1137 |
| 1063615 | N/A | N/A | 6991 | 7006 | CAGTAAAGGTCGGCAC | 188 | 1138 |
| 1063647 | N/A | N/A | 7305 | 7320 | TCGAGTAACTTTTTAA | 44 | 1139 |
| 1063679 | N/A | N/A | 7429 | 7444 | GGTGAGAGGCCATCCT | 108 | 1140 |
| 1063711 | N/A | N/A | 7874 | 7889 | TCAGAATAGCCTACAC | 121 | 1141 |
| 1063743 | N/A | N/A | 8017 | 8032 | ACATTTGACTAGCTT | 40 | 1142 |
| 1063775 | N/A | N/A | 8111 | 8126 | AGCCTCGAAAACCCTG | 145 | 1143 |
| 1063806 | N/A | N/A | 8597 | 8612 | GAACCCACAGTCTCAG | 110 | 1144 |
| 1063838 | N/A | N/A | 8875 | 8890 | AATAAGGCTGGCATGT | 110 | 1145 |
| 1063870 | N/A | N/A | 9113 | 9128 | GTGGAGGGACGGCCTG | 92 | 1146 |
| 1063902 | N/A | N/A | 9535 | 9550 | TATCCCTATCCCTTAC | 180 | 1147 |
| 1063934 | N/A | N/A | 9694 | 9709 | GGCACAAACATGAGGC | 117 | 1148 |
| 1063966 | N/A | N/A | 10310 | 10325 | ACAACTCAGGATCACA | 62 | 1149 |
| 1063998 | N/A | N/A | 10582 | 10597 | CACCTAAACCCCCCTG | 114 | 1150 |
| 1064030 | N/A | N/A | 11157 | 11172 | GTCGGATGATGCCTGG | 81 | 1151 |

TABLE 19-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064062 | N/A | N/A | 11452 | 11467 | TTGTGAGCGGATGCAT | 91 | 1152 |
| 1064094 | N/A | N/A | 11579 | 11594 | AATATAGTAGCTGGAG | 43 | 1153 |
| 1064128 | N/A | N/A | 11660 | 11675 | CCACCCCGATTTTCCT | 125 | 1154 |
| 1064160 | N/A | N/A | 11744 | 11759 | GGATGACAGTCAAGGT | 50 | 1155 |
| 1064192 | N/A | N/A | 11827 | 11842 | TGCCAAAATAGTTCTC | 88 | 1156 |
| 1064224 | N/A | N/A | 11930 | 11945 | CTACAGGCCTGAGATC | 114 | 1157 |
| 1064256 | N/A | N/A | 11996 | 12011 | GGATGAATCAAGCCCC | 97 | 1158 |
| 1064288 | N/A | N/A | 12318 | 12333 | TTGGCATGCTCTGGCC | 118 | 1159 |
| 1064320 | N/A | N/A | 12455 | 12470 | GTTAGAGTAAGAGCTG | 101 | 1160 |
| 1064352 | N/A | N/A | 12639 | 12654 | TTCTGAGAAGGCATTG | 118 | 1161 |
| 1064384 | N/A | N/A | 12822 | 12837 | CAGGGAATTTGATCAG | 92 | 1162 |
| 1064416 | N/A | N/A | 12961 | 12976 | GATGACTTGGCTTTAG | 83 | 1163 |
| 1064448 | N/A | N/A | 13240 | 13255 | GTATGGTTGTTCTGGG | 101 | 1164 |

TABLE 20

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910956 | 1800 | 1815 | 14210 | 14225 | AGTAATCTGTGCGAGC | 23 | 250 |
| 911144 | N/A | N/A | 7355 | 7370 | TGCTATGATCATCCCC | 40 | 65 |
| 1062016 | 40 | 55 | 440 | 455 | GAAGCCGCAGACCTCT | 53 | 1165 |
| 1062048 | 156 | 171 | N/A | N/A | GCAGGCTTGGTGAAGT | 48 | 1166 |
| 1062080 | 323 | 338 | 6861 | 6876 | AAGATCTCGGCCCTGG | 131 | 1167 |
| 1062112 | 484 | 499 | 7549 | 7564 | TGCATGAAATGTGGCC | 39 | 1168 |
| 1062144 | 662 | 677 | 8239 | 8254 | CCTGGACACCCATTCC | 42 | 1169 |
| 1062176 | 802 | 817 | 8448 | 8463 | TCTTCGAAGACCTTCT | 76 | 1170 |
| 1062208 | 981 | 996 | 9776 | 9791 | AAGCCTTGGTCAGTGC | 92 | 1171 |
| 1062240 | 1112 | 1127 | 11268 | 11283 | CCACAGGTGCCTCCGG | 49 | 1172 |
| 1062272 | 1261 | 1276 | 13491 | 13506 | ATCTCATTGAGTGTCC | 74* | 1173 |
| 1062304 | 1460 | 1475 | 13870 | 13885 | AGGTGTAGGGTTGGAA | 41 | 1174 |
| 1062336 | 1746 | 1761 | 14156 | 14171 | TGTTTGGCTGCAGGGC | 19 | 1175 |
| 1062368 | 1900 | 1915 | 14310 | 14325 | TTGAGTGTACTGAGGC | 3 | 1176 |
| 1062400 | 2068 | 2083 | 14478 | 14493 | AGATCCTGAGGGTACT | 72 | 1177 |
| 1062432 | 2274 | 2289 | N/A | N/A | TGAGGCATGGATCAGG | 54 | 1178 |
| 1062464 | N/A | N/A | 8327 | 8342 | GAGGGCGAGGATCCTT | 40 | 1179 |
| 1062496 | N/A | N/A | 13637 | 13652 | GCCTATGAGCCCAGAC | 67 | 1180 |
| 1062528 | N/A | N/A | 567 | 582 | GAGCAGGGACACTCAC | 210 | 1181 |
| 1062560 | N/A | N/A | 728 | 743 | TAAGTCTTCTGCCATT | 23 | 1182 |

TABLE 20-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062592 | N/A | N/A | 937 | 952 | GATGAGAGGCATCAAG | 140 | 1183 |
| 1062624 | N/A | N/A | 1142 | 1157 | CAAGAAAAGAGAGCGG | 39 | 1184 |
| 1062656 | N/A | N/A | 1273 | 1288 | TACTAGGGTGAACAGA | 77 | 1185 |
| 1062689 | N/A | N/A | 1393 | 1408 | TACGGTTGACAATGGT | 36 | 1186 |
| 1062721 | N/A | N/A | 1533 | 1548 | CGTGAGCACTTACTTT | 80 | 1187 |
| 1062753 | N/A | N/A | 1750 | 1765 | AACGAGAAACAACCGG | 26 | 1188 |
| 1062785 | N/A | N/A | 1908 | 1923 | CTAGGGTTAGCTTAAG | 81 | 1189 |
| 1062817 | N/A | N/A | 2086 | 2101 | AAGATGAACACCCTAT | 78 | 1190 |
| 1062849 | N/A | N/A | 2260 | 2275 | GACTAACCTATTTGAC | 66 | 1191 |
| 1062881 | N/A | N/A | 2419 | 2434 | AGTCTGGCTCCAGTAC | 89 | 1192 |
| 1062913 | N/A | N/A | 2628 | 2643 | ACACCTAATGCTGATC | 95 | 1193 |
| 1062945 | N/A | N/A | 2763 | 2778 | GATAATTAGGGAGAAG | 30 | 1194 |
| 1062977 | N/A | N/A | 2955 | 2970 | GCTGGGTATTGAATTG | 75 | 1195 |
| 1063009 | N/A | N/A | 3154 | 3169 | ACACAAAGAGCGAGCA | 119 | 1196 |
| 1063041 | N/A | N/A | 3257 | 3272 | GTCTGGTTAAGTCATT | 67 | 1197 |
| 1063073 | N/A | N/A | 3405 | 3420 | TCCCACCTAGAGTCCT | 78 | 1198 |
| 1063105 | N/A | N/A | 3742 | 3757 | GCCCATCATCAGACTC | 34 | 1199 |
| 1063137 | N/A | N/A | 3951 | 3966 | CTTCATAGGGCCTCTT | 35 | 1200 |
| 1063169 | N/A | N/A | 4152 | 4167 | GATACTGGGACCCCTG | 38 | 1201 |
| 1063201 | N/A | N/A | 4356 | 4371 | CACCCCACAGGTTTCG | 46 | 1202 |
| 1063232 | N/A | N/A | 4443 | 4458 | CCCAGATTTTCCGCC | 70 | 1203 |
| 1063264 | N/A | N/A | 4631 | 4646 | GAGATGATCTGTCTGG | 47 | 1204 |
| 1063296 | N/A | N/A | 4800 | 4815 | ATTTCGGTGCAAATGG | 54 | 1205 |
| 1063328 | N/A | N/A | 5143 | 5158 | GGGCTTAGAACATTAC | 65 | 1206 |
| 1063360 | N/A | N/A | 5416 | 5431 | GAACTCCACTTCTTTC | 52 | 1207 |
| 1063392 | N/A | N/A | 5592 | 5607 | TCCGGGCCCCTGCTG | 65 | 1208 |
| 1063424 | N/A | N/A | 5769 | 5784 | GCCTGTAGAAGCTTCT | 97 | 1209 |
| 1063456 | N/A | N/A | 5931 | 5946 | TGAAGAGTCTGGCATT | 179 | 1210 |
| 1063488 | N/A | N/A | 6032 | 6047 | GTTTTAGCTTGAGCAG | 31 | 1211 |
| 1063520 | N/A | N/A | 6195 | 6210 | TATTGTAACAGTCCTG | 30 | 1212 |
| 1063552 | N/A | N/A | 6381 | 6396 | CCCTCCACTTGAGAGC | 33 | 1213 |
| 1063584 | N/A | N/A | 6589 | 6604 | TTGGCTGGGACATGTC | 39 | 1214 |
| 1063616 | N/A | N/A | 6993 | 7008 | CACAGTAAAGGTCGGC | 71 | 1215 |
| 1063648 | N/A | N/A | 7306 | 7321 | ATCGAGTAACTTTTTA | 14 | 1216 |
| 1063680 | N/A | N/A | 7430 | 7445 | GGGTGAGAGGCCATCC | 229 | 1217 |
| 1063712 | N/A | N/A | 7876 | 7891 | ATTCAGAATAGCCTAC | 105 | 1218 |
| 1063744 | N/A | N/A | 8018 | 8033 | GACATTTTGACTAGCT | 5 | 1219 |

TABLE 20-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063776 | N/A | N/A | 8115 | 8130 | CCTGAGCCTCGAAAAC | 72 | 1220 |
| 1063807 | N/A | N/A | 8599 | 8614 | TTGAACCCACAGTCTC | 44 | 1221 |
| 1063839 | N/A | N/A | 8876 | 8891 | GAATAAGGCTGGCATG | 90 | 1222 |
| 1063871 | N/A | N/A | 9172 | 9187 | TTGGAAGTGTGGTGAG | 49 | 1223 |
| 1063903 | N/A | N/A | 9536 | 9551 | CTATCCCTATCCCTTA | 56 | 1224 |
| 1063935 | N/A | N/A | 9695 | 9710 | TGGCACAAACATGAGG | 131 | 1225 |
| 1063967 | N/A | N/A | 10312 | 10327 | TAACAACTCAGGATCA | 28 | 1226 |
| 1063999 | N/A | N/A | 10583 | 10598 | TCACCTAAACCCCCCT | 34 | 1227 |
| 1064031 | N/A | N/A | 11159 | 11174 | TTGTCGGATGATGCCT | 33 | 1228 |
| 1064063 | N/A | N/A | 11455 | 11470 | CTTTTGTGAGCGGATG | 50 | 1229 |
| 1064095 | N/A | N/A | 11580 | 11595 | GAATATAGTAGCTGGA | 12 | 1230 |
| 1064129 | N/A | N/A | 11661 | 11676 | TCCACCCCGATTTTCC | 177 | 1231 |
| 1064161 | N/A | N/A | 11747 | 11762 | CCAGGATGACAGTCAA | 26 | 1232 |
| 1064193 | N/A | N/A | 11848 | 11863 | ATTTATTCTTTGCACC | 75 | 1233 |
| 1064225 | N/A | N/A | 11931 | 11946 | TCTACAGGCCTGAGAT | 77 | 1234 |
| 1064257 | N/A | N/A | 12017 | 12032 | AGGAACTCTGTCAGAG | 39 | 1235 |
| 1064289 | N/A | N/A | 12321 | 12336 | AATTTGGCATGCTCTG | 186 | 1236 |
| 1064321 | N/A | N/A | 12456 | 12471 | AGTTAGAGTAAGAGCT | 160 | 1237 |
| 1064353 | N/A | N/A | 12647 | 12662 | GATGAAGGTTCTGAGA | 39 | 1238 |
| 1064385 | N/A | N/A | 12824 | 12839 | GTCAGGGAATTTGATC | 89 | 1239 |
| 1064417 | N/A | N/A | 12965 | 12980 | ATGGGATGACTTGGCT | 81 | 1240 |
| 1064449 | N/A | N/A | 13243 | 13258 | TGGGTATGGTTGTTCT | 42 | 1241 |

TABLE 21

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910950 | 1434 | 1449 | 13844 | 13859 | GCCTCTGGCTCCGTTT | 109 | 94 |
| 911144 | N/A | N/A | 7355 | 7370 | TGCTATGATCATCCCC | 12 | 65 |
| 1062017 | 44 | 59 | 444 | 459 | TGTGGAAGCCGCAGAC | 32 | 1242 |
| 1062049 | 161 | 176 | N/A | N/A | CAAGGGCAGGCTTGGT | 120 | 1243 |
| 1062081 | 325 | 340 | 6863 | 6878 | CGAAGATCTCGGCCCT | 52 | 1244 |
| 1062113 | 486 | 501 | 7551 | 7566 | GGTGCATGAAATGTGG | 34 | 1245 |
| 1062145 | 663 | 678 | 8240 | 8255 | CCCTGGACACCCATTC | 57 | 1246 |
| 1062177 | 803 | 818 | 8449 | 8464 | CTCTTCGAAGACCTTC | 127 | 1247 |
| 1062209 | 982 | 997 | 9777 | 9792 | GAAGCCTTGGTCAGTG | 35 | 1248 |
| 1062241 | 1116 | 1131 | 11272 | 11287 | TACCCCACAGGTGCCT | 53 | 1249 |
| 1062273 | 1268 | 1283 | 13498 | 13513 | GTGGTAGATCTCATTG | 61* | 1250 |

TABLE 21-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062305 | 1461 | 1476 | 13871 | 13886 | CAGGTGTAGGGTTGGA | 18 | 1251 |
| 1062337 | 1756 | 1771 | 14166 | 14181 | GTGAAGGCTCTGTTTG | 37 | 1252 |
| 1062369 | 1902 | 1917 | 14312 | 14327 | GTTTGAGTGTACTGAG | 23 | 1253 |
| 1062401 | 2070 | 2085 | 14480 | 14495 | TCAGATCCTGAGGGTA | 123 | 1254 |
| 1062433 | 2275 | 2290 | N/A | N/A | CTGAGGCATGGATCAG | 36 | 1255 |
| 1062465 | N/A | N/A | 8328 | 8343 | GGAGGGCGAGGATCCT | 100 | 1256 |
| 1062497 | N/A | N/A | 13642 | 13657 | AATGTGCCTATGAGCC | 136 | 1257 |
| 1062529 | N/A | N/A | 624 | 639 | CCCGCCGTGCCTACCT | 21 | 1258 |
| 1062561 | N/A | N/A | 740 | 755 | GTACTTCACCTTTAAG | 33 | 1259 |
| 1062593 | N/A | N/A | 938 | 953 | GGATGAGAGGCATCAA | 54 | 1260 |
| 1062625 | N/A | N/A | 1143 | 1158 | GCAAGAAAAGAGAGCG | 127 | 1261 |
| 1062657 | N/A | N/A | 1274 | 1289 | CTACTAGGGTGAACAG | 60 | 1262 |
| 1062690 | N/A | N/A | 1394 | 1409 | CTACGGTTGACAATGG | 44 | 1263 |
| 1062722 | N/A | N/A | 1570 | 1585 | TCTAATTTGGTTACAG | 55 | 1264 |
| 1062754 | N/A | N/A | 1751 | 1766 | AAACGAGAAACAACCG | 40 | 1265 |
| 1062786 | N/A | N/A | 1910 | 1925 | ACCTAGGGTTAGCTTA | 93 | 1266 |
| 1062818 | N/A | N/A | 2087 | 2102 | TAAGATGAACACCCTA | 125 | 1267 |
| 1062850 | N/A | N/A | 2261 | 2276 | AGACTAACCTATTTGA | 41 | 1268 |
| 1062882 | N/A | N/A | 2436 | 2451 | CTGGGTTTGTCCCAGA | 119 | 1269 |
| 1062914 | N/A | N/A | 2630 | 2645 | TAACACCTAATGCTGA | 128 | 1270 |
| 1062946 | N/A | N/A | 2767 | 2782 | CTGAGATAATTAGGGA | 52 | 1271 |
| 1062978 | N/A | N/A | 2956 | 2971 | GGCTGGGTATTGAATT | 36 | 1272 |
| 1063010 | N/A | N/A | 3155 | 3170 | CACACAAAGAGCGAGC | 45 | 1273 |
| 1063042 | N/A | N/A | 3267 | 3282 | CTTCTACGCTGTCTGG | 57 | 1274 |
| 1063074 | N/A | N/A | 3425 | 3440 | GGAGAGAGCCAGAACC | 30 | 1275 |
| 1063106 | N/A | N/A | 3748 | 3763 | TACAGAGCCCATCATC | 52 | 1276 |
| 1063138 | N/A | N/A | 3968 | 3983 | AGTCAGGCAGCTTGCT | 42 | 1277 |
| 1063170 | N/A | N/A | 4153 | 4168 | AGATACTGGGACCCCT | 69 | 1278 |
| 1063202 | N/A | N/A | 4363 | 4378 | GATACCCCACCCCACA | 142 | 1279 |
| 1063233 | N/A | N/A | 4444 | 4459 | GCCCAGATTTTTCCGC | 51 | 1280 |
| 1063265 | N/A | N/A | 4632 | 4647 | GGAGATGATCTGTCTG | 72 | 1281 |
| 1063297 | N/A | N/A | 4801 | 4816 | GATTTCGGTGCAAATG | 95 | 1282 |
| 1063329 | N/A | N/A | 5159 | 5174 | GTTCTTAGTCTCCTGG | 20 | 1283 |
| 1063361 | N/A | N/A | 5418 | 5433 | GAGAACTCCACTTCTT | 121 | 1284 |
| 1063393 | N/A | N/A | 5602 | 5617 | CCACAATGGCTCCGGG | 51 | 1285 |
| 1063425 | N/A | N/A | 5818 | 5833 | AGCATGGCAAGTGACA | 41 | 1286 |
| 1063457 | N/A | N/A | 5932 | 5947 | ATGAAGAGTCTGGCAT | 130 | 1287 |

TABLE 21-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063489 | N/A | N/A | 6033 | 6048 | GGTTTTAGCTTGAGCA | 63 | 1288 |
| 1063521 | N/A | N/A | 6196 | 6211 | CTATTGTAACAGTCCT | 86 | 1289 |
| 1063553 | N/A | N/A | 6395 | 6410 | CAATGGTTGTTTCCCC | 33 | 1290 |
| 1063585 | N/A | N/A | 6592 | 6607 | GCATTGGCTGGGACAT | 93 | 1291 |
| 1063617 | N/A | N/A | 6994 | 7009 | CCACAGTAAAGGTCGG | 46 | 1292 |
| 1063649 | N/A | N/A | 7307 | 7322 | GATCGAGTAACTTTTT | 16 | 1293 |
| 1063681 | N/A | N/A | 7555 | 7570 | ACCTGGTGCATGAAAT | 50 | 1294 |
| 1063713 | N/A | N/A | 7878 | 7893 | CAATTCAGAATAGCCT | 53 | 1295 |
| 1063745 | N/A | N/A | 8019 | 8034 | TGACATTTTGACTAGC | 25 | 1296 |
| 1063777 | N/A | N/A | 8134 | 8149 | ATTTTGAGCTTCCCAC | 146 | 1297 |
| 1063808 | N/A | N/A | 8600 | 8615 | TTTGAACCCACAGTCT | 160 | 1298 |
| 1063840 | N/A | N/A | 8877 | 8892 | GGAATAAGGCTGGCAT | 46 | 1299 |
| 1063872 | N/A | N/A | 9181 | 9196 | GAGATAATGTTGGAAG | 97 | 1300 |
| 1063904 | N/A | N/A | 9537 | 9552 | ACTATCCCTATCCCTT | 95 | 1301 |
| 1063936 | N/A | N/A | 9787 | 9802 | CACCACAGATGAAGCC | 48 | 1302 |
| 1063968 | N/A | N/A | 10313 | 10328 | TTAACAACTCAGGATC | 145 | 1303 |
| 1064000 | N/A | N/A | 10585 | 10600 | AGTCACCTAAACCCCC | 87 | 1304 |
| 1064032 | N/A | N/A | 11300 | 11315 | TTACCTGGGAATGTGC | 50 | 1305 |
| 1064064 | N/A | N/A | 11456 | 11471 | GCTTTTGTGAGCGGAT | 27 | 1306 |
| 1064096 | N/A | N/A | 11581 | 11596 | CGAATATAGTAGCTGG | 21 | 1307 |
| 1064130 | N/A | N/A | 11662 | 11677 | ATCCACCCCGATTTTC | 111 | 1308 |
| 1064162 | N/A | N/A | 11769 | 11784 | TGCAAGAGGTTAAATG | 129 | 1309 |
| 1064194 | N/A | N/A | 11861 | 11876 | CATAAGTTGTATCATT | 116 | 1310 |
| 1064226 | N/A | N/A | 11932 | 11947 | GTCTACAGGCCTGAGA | 51 | 1311 |
| 1064258 | N/A | N/A | 12018 | 12033 | GAGGAACTCTGTCAGA | 122 | 1312 |
| 1064290 | N/A | N/A | 12322 | 12337 | GAATTTGGCATGCTCT | 50 | 1313 |
| 1064322 | N/A | N/A | 12457 | 12472 | GAGTTAGAGTAAGAGC | 51 | 1314 |
| 1064354 | N/A | N/A | 12648 | 12663 | GGATGAAGGTTCTGAG | 89 | 1315 |
| 1064386 | N/A | N/A | 12825 | 12840 | GGTCAGGGAATTTGAT | 134 | 1316 |
| 1064418 | N/A | N/A | 13014 | 13029 | TTAAGAGTCAGGCTGG | 59 | 1317 |
| 1064450 | N/A | N/A | 13244 | 13259 | GTGGGTATGGTTGTTC | 90 | 1318 |

TABLE 22

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 % UTC) | SEQ ID NO |
|---|---|---|---|---|---|---|---|
| 910950 | 1434 | 1449 | 13844 | 13859 | GCCTCTGGCTCCGTTT | 109 | 94 |
| 911144 | N/A | N/A | 7355 | 7370 | TGCTATGATCATCCCC | 21 | 65 |

TABLE 22-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 % UTC | SEQ ID NO |
|---|---|---|---|---|---|---|---|
| 1062018 | 46 | 61 | 446 | 461 | GGTGTGGAAGCCGCAG | 49 | 1319 |
| 1062050 | 172 | 187 | 6710 | 6725 | GGGTCCTTGTCCAAGG | 43 | 1320 |
| 1062082 | 328 | 343 | 6866 | 6881 | CCTCGAAGATCTCGGC | 112 | 1321 |
| 1062114 | 487 | 502 | 7552 | 7567 | TGGTGCATGAAATGTG | 137 | 1322 |
| 1062146 | 664 | 679 | 8241 | 8256 | TCCCTGGACACCCATT | 37 | 1323 |
| 1062178 | 804 | 819 | 8450 | 8465 | GCTCTTCGAAGACCTT | 35 | 1324 |
| 1062210 | 984 | 999 | 9779 | 9794 | ATGAAGCCTTGGTCAG | 52 | 1325 |
| 1062242 | 1117 | 1132 | 11273 | 11288 | CTACCCCACAGGTGCC | 80 | 1326 |
| 1062274 | 1293 | 1308 | 13523 | 13538 | AGAAGGCAAACATGCG | 41 | 1327 |
| 1062306 | 1463 | 1478 | 13873 | 13888 | GCCAGGTGTAGGGTTG | 35 | 1328 |
| 1062338 | 1757 | 1772 | 14167 | 14182 | TGTGAAGGCTCTGTTT | 86 | 1329 |
| 1062370 | 1903 | 1918 | 14313 | 14328 | TGTTTGAGTGTACTGA | 46 | 1330 |
| 1062402 | 2071 | 2086 | 14481 | 14496 | CTCAGATCCTGAGGGT | 88 | 1331 |
| 1062434 | 2276 | 2291 | N/A | N/A | GCTGAGGCATGGATCA | 41 | 1332 |
| 1062466 | N/A | N/A | 8329 | 8344 | AGGAGGGCGAGGATCC | 43 | 1333 |
| 1062498 | N/A | N/A | 13645 | 13660 | CCCAATGTGCCTATGA | 55 | 1334 |
| 1062530 | N/A | N/A | 643 | 658 | CCAGAGGGCCCCTGAC | 52 | 1335 |
| 1062562 | N/A | N/A | 741 | 756 | AGTACTTCACCTTTAA | 17 | 1336 |
| 1062594 | N/A | N/A | 940 | 955 | AAGGATGAGAGGCATC | 158 | 1337 |
| 1062626 | N/A | N/A | 1180 | 1195 | TAGGCTGGATGCTGGC | 167 | 1338 |
| 1062658 | N/A | N/A | 1276 | 1291 | TGCTACTAGGGTGAAC | 126 | 1339 |
| 1062691 | N/A | N/A | 1395 | 1410 | ACTACGGTTGACAATG | 39 | 1340 |
| 1062723 | N/A | N/A | 1576 | 1591 | CATGATTCTAATTTGG | 21 | 1341 |
| 1062755 | N/A | N/A | 1773 | 1788 | AGTCAGGGATGTTTAT | 50 | 1342 |
| 1062787 | N/A | N/A | 1911 | 1926 | CACCTAGGGTTAGCTT | 134 | 1343 |
| 1062819 | N/A | N/A | 2088 | 2103 | ATAAGATGAACACCCT | 42 | 1344 |
| 1062851 | N/A | N/A | 2262 | 2277 | AAGACTAACCTATTTG | 48 | 1345 |
| 1062883 | N/A | N/A | 2437 | 2452 | GCTGGGTTTGTCCCAG | 71 | 1346 |
| 1062915 | N/A | N/A | 2632 | 2647 | TTTAACACCTAATGCT | 98 | 1347 |
| 1062947 | N/A | N/A | 2768 | 2783 | TCTGAGATAATTAGGG | 101 | 1348 |
| 1062979 | N/A | N/A | 2958 | 2973 | ATGGCTGGGTATTGAA | 24 | 1349 |
| 1063011 | N/A | N/A | 3178 | 3193 | GGATACATAGAGACAA | 57 | 1350 |
| 1063043 | N/A | N/A | 3276 | 3291 | GCCAGGGCCCTTCTAC | 114 | 1351 |
| 1063107 | N/A | N/A | 3750 | 3765 | AATACAGAGCCCATCA | 50 | 1352 |
| 1063139 | N/A | N/A | 3971 | 3986 | GAAAGTCAGGCAGCTT | 43 | 1353 |
| 1063171 | N/A | N/A | 4156 | 4171 | CACAGATACTGGGACC | 60 | 1354 |
| 1063203 | N/A | N/A | 4366 | 4381 | GCAGATACCCCACCCC | 24 | 1355 |

TABLE 22-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 % UTC) | SEQ ID NO |
|---|---|---|---|---|---|---|---|
| 1063234 | N/A | N/A | 4449 | 4464 | GACTTGCCCAGATTTT | 28 | 1356 |
| 1063266 | N/A | N/A | 4633 | 4648 | TGGAGATGATCTGTCT | 48 | 1357 |
| 1063298 | N/A | N/A | 4802 | 4817 | CGATTTCGGTGCAAAT | 37 | 1358 |
| 1063330 | N/A | N/A | 5160 | 5175 | AGTTCTTAGTCTCCTG | 9 | 1359 |
| 1063362 | N/A | N/A | 5420 | 5435 | TTGAGAACTCCACTTC | 70 | 1360 |
| 1063394 | N/A | N/A | 5606 | 5621 | CCCTCCACAATGGCTC | 28 | 1361 |
| 1063426 | N/A | N/A | 5820 | 5835 | CCAGCATGGCAAGTGA | 46 | 1362 |
| 1063458 | N/A | N/A | 5933 | 5948 | CATGAAGAGTCTGGCA | 32 | 1363 |
| 1063490 | N/A | N/A | 6034 | 6049 | GGGTTTTAGCTTGAGC | 35 | 1364 |
| 1063522 | N/A | N/A | 6198 | 6213 | GGCTATTGTAACAGTC | 112 | 1365 |
| 1063554 | N/A | N/A | 6398 | 6413 | GGGCAATGGTTGTTTC | 82 | 1366 |
| 1063586 | N/A | N/A | 6593 | 6608 | GGCATTGGCTGGGACA | 110 | 1367 |
| 1063618 | N/A | N/A | 6996 | 7011 | TGCCACAGTAAAGGTC | 47 | 1368 |
| 1063650 | N/A | N/A | 7308 | 7323 | AGATCGAGTAACTTTT | 8 | 1369 |
| 1063682 | N/A | N/A | 7556 | 7571 | TACCTGGTGCATGAAA | 58 | 1370 |
| 1063714 | N/A | N/A | 7879 | 7894 | GCAATTCAGAATAGCC | 49 | 1371 |
| 1063746 | N/A | N/A | 8020 | 8035 | CTGACATTTTGACTAG | 35 | 1372 |
| 1063778 | N/A | N/A | 8146 | 8161 | ACAAGGCCTCTCATTT | 58 | 1373 |
| 1063809 | N/A | N/A | 8623 | 8638 | GCCAGTCAGGGATGGA | 55 | 1374 |
| 1063841 | N/A | N/A | 8878 | 8893 | TGGAATAAGGCTGGCA | 37 | 1375 |
| 1063873 | N/A | N/A | 9203 | 9218 | CTTGAGCCTGGCCAGA | 87 | 1376 |
| 1063905 | N/A | N/A | 9539 | 9554 | GCACTATCCCTATCCC | 16 | 1377 |
| 1063937 | N/A | N/A | 9789 | 9804 | CTCACCACAGATGAAG | 62 | 1378 |
| 1063969 | N/A | N/A | 10314 | 10329 | TTTAACAACTCAGGAT | 72 | 1379 |
| 1064001 | N/A | N/A | 10588 | 10603 | GAAAGTCACCTAAACC | 35 | 1380 |
| 1064033 | N/A | N/A | 11302 | 11317 | TCTTACCTGGGAATGT | 145 | 1381 |
| 1064065 | N/A | N/A | 11457 | 11472 | AGCTTTTGTGAGCGGA | 54 | 1382 |
| 1064097 | N/A | N/A | 11582 | 11597 | CCGAATATAGTAGCTG | 54 | 1383 |
| 1064131 | N/A | N/A | 11664 | 11679 | GAATCCACCCCGATTT | 56 | 1384 |
| 1064163 | N/A | N/A | 11771 | 11786 | GATGCAAGAGGTTAAA | 43 | 1385 |
| 1064195 | N/A | N/A | 11863 | 11878 | GACATAAGTTGTATCA | 87 | 1386 |
| 1064227 | N/A | N/A | 11934 | 11949 | GAGTCTACAGGCCTGA | 38 | 1387 |
| 1064259 | N/A | N/A | 12019 | 12034 | GGAGGAACTCTGTCAG | 41 | 1388 |
| 1064291 | N/A | N/A | 12323 | 12338 | AGAATTTGGCATGCTC | 43 | 1389 |
| 1064323 | N/A | N/A | 12458 | 12473 | GGAGTTAGAGTAAGAG | 76 | 1390 |
| 1064355 | N/A | N/A | 12649 | 12664 | AGGATGAAGGTTCTGA | 77 | 1391 |
| 1064387 | N/A | N/A | 12847 | 12862 | TTCGGTGTGGAGTGAG | 82 | 1392 |

TABLE 22-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 % UTC) | SEQ ID NO |
|---|---|---|---|---|---|---|---|
| 1064419 | N/A | N/A | 13016 | 13031 | GGTTAAGAGTCAGGCT | 40 | 1393 |
| 1064451 | N/A | N/A | 13245 | 13260 | TGTGGGTATGGTTGTT | 35 | 1394 |

TABLE 23

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910950 | 1434 | 1449 | 13844 | 13859 | GCCTCTGGCTCCGTTT | 200 | 94 |
| 911144 | N/A | N/A | 7355 | 7370 | TGCTATGATCATCCCC | 14 | 65 |
| 1062019 | 49 | 64 | 449 | 464 | TACGGTGTGGAAGCCG | 65 | 1395 |
| 1062051 | 174 | 189 | 6712 | 6727 | TCGGGTCCTTGTCCAA | 38 | 1396 |
| 1062083 | 329 | 344 | 6867 | 6882 | GCCTCGAAGATCTCGG | 67 | 1397 |
| 1062115 | 488 | 503 | 7553 | 7568 | CTGGTGCATGAAATGT | 62 | 1398 |
| 1062147 | 669 | 684 | 8246 | 8261 | CCGGCTCCCTGGACAC | 61 | 1399 |
| 1062179 | 810 | 825 | 8456 | 8471 | CCTCTGGCTCTTCGAA | 148 | 1400 |
| 1062211 | 987 | 1002 | 9782 | 9797 | CAGATGAAGCCTTGGT | 39 | 1401 |
| 1062243 | 1118 | 1133 | 11274 | 11289 | GCTACCCCACAGGTGC | 108 | 1402 |
| 1062275 | 1312 | 1327 | 13542 | 13557 | GTGGCAGGATGGTTTC | 52 | 1403 |
| 1062307 | 1482 | 1497 | 13892 | 13907 | CTTGATCTTGAGGTCA | 59 | 1404 |
| 1062339 | 1764 | 1779 | 14174 | 14189 | GGCTGGTTGTGAAGGC | 40 | 1405 |
| 1062371 | 1904 | 1919 | 14314 | 14329 | TTGTTTGAGTGTACTG | 64 | 1406 |
| 1062403 | 2076 | 2091 | 14486 | 14501 | GGGACCTCAGATCCTG | 78 | 1407 |
| 1062435 | 2283 | 2298 | N/A | N/A | AGTCTAAGCTGAGGCA | 68 | 1408 |
| 1062467 | N/A | N/A | 8330 | 8345 | TAGGAGGGCGAGGATC | 90 | 1409 |
| 1062499 | N/A | N/A | 13646 | 13661 | CCCCAATGTGCCTATG | 93 | 1410 |
| 1062531 | N/A | N/A | 644 | 659 | ACCAGAGGGCCCCTGA | 95 | 1411 |
| 1062563 | N/A | N/A | 742 | 757 | AAGTACTTCACCTTTA | 50 | 1412 |
| 1062595 | N/A | N/A | 1002 | 1017 | CGGGAGAAAGAGAGGC | 38 | 1413 |
| 1062627 | N/A | N/A | 1183 | 1198 | CTCTAGGCTGGATGCT | 65 | 1414 |
| 1062659 | N/A | N/A | 1287 | 1302 | TGCAATCCTCCTGCTA | 117 | 1415 |
| 1062692 | N/A | N/A | 1397 | 1412 | AAACTACGGTTGACAA | 71 | 1416 |
| 1062724 | N/A | N/A | 1577 | 1592 | GCATGATTCTAATTTG | 5 | 1417 |
| 1062756 | N/A | N/A | 1784 | 1799 | TCCAAGGAAGCAGTCA | 78 | 1418 |
| 1062788 | N/A | N/A | 1914 | 1929 | ACTCACCTAGGGTTAG | 92 | 1419 |
| 1062820 | N/A | N/A | 2089 | 2104 | AATAAGATGAACACCC | 73 | 1420 |
| 1062852 | N/A | N/A | 2305 | 2320 | GGACTTTCTAAGCACA | 48 | 1421 |
| 1062884 | N/A | N/A | 2438 | 2453 | CGCTGGGTTTGTCCCA | 65 | 1422 |

TABLE 23-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062916 | N/A | N/A | 2634 | 2649 | GTTTTAACACCTAATG | 65 | 1423 |
| 1062948 | N/A | N/A | 2790 | 2805 | GGAGTATGGTTTAACA | 38 | 1424 |
| 1062980 | N/A | N/A | 2961 | 2976 | CCCATGGCTGGGTATT | 109 | 1425 |
| 1063012 | N/A | N/A | 3179 | 3194 | GGGATACATAGAGACA | 78 | 1426 |
| 1063044 | N/A | N/A | 3277 | 3292 | GGCCAGGGCCCTTCTA | 100 | 1427 |
| 1063076 | N/A | N/A | 3491 | 3506 | GAATGGTAGCCCAGGT | 64 | 1428 |
| 1063108 | N/A | N/A | 3751 | 3766 | CAATACAGAGCCCATC | 73 | 1429 |
| 1063140 | N/A | N/A | 3972 | 3987 | TGAAAGTCAGGCAGCT | 73 | 1430 |
| 1063172 | N/A | N/A | 4157 | 4172 | CCACAGATACTGGGAC | 97 | 1431 |
| 1063204 | N/A | N/A | 4367 | 4382 | GGCAGATACCCCACCC | 73 | 1432 |
| 1063235 | N/A | N/A | 4450 | 4465 | CGACTTGCCCAGATTT | 59 | 1433 |
| 1063267 | N/A | N/A | 4659 | 4674 | CATAGATACATTCTCA | 65 | 1434 |
| 1063299 | N/A | N/A | 4804 | 4819 | ACCGATTTCGGTGCAA | 65 | 1435 |
| 1063331 | N/A | N/A | 5161 | 5176 | AAGTTCTTAGTCTCCT | 19 | 1436 |
| 1063363 | N/A | N/A | 5421 | 5436 | CTTGAGAACTCCACTT | 69 | 1437 |
| 1063395 | N/A | N/A | 5609 | 5624 | AAGCCCTCCACAATGG | 53 | 1438 |
| 1063427 | N/A | N/A | 5821 | 5836 | TCCAGCATGGCAAGTG | 74 | 1439 |
| 1063459 | N/A | N/A | 5934 | 5949 | ACATGAAGAGTCTGGC | 37 | 1440 |
| 1063491 | N/A | N/A | 6036 | 6051 | ATGGGTTTTAGCTTGA | 21 | 1441 |
| 1063523 | N/A | N/A | 6199 | 6214 | AGGCTATTGTAACAGT | 52 | 1442 |
| 1063555 | N/A | N/A | 6399 | 6414 | AGGGCAATGGTTGTTT | 132 | 1443 |
| 1063587 | N/A | N/A | 6603 | 6618 | GGTCAAAGCAGGCATT | 30 | 1444 |
| 1063619 | N/A | N/A | 7005 | 7020 | CCCGCCCAGTGCCACA | 23 | 1445 |
| 1063651 | N/A | N/A | 7309 | 7324 | GAGATCGAGTAACTTT | 27 | 1446 |
| 1063683 | N/A | N/A | 7557 | 7572 | ATACCTGGTGCATGAA | 72 | 1447 |
| 1063715 | N/A | N/A | 7880 | 7895 | TGCAATTCAGAATAGC | 59 | 1448 |
| 1063747 | N/A | N/A | 8021 | 8036 | GCTGACATTTTGACTA | 63 | 1449 |
| 1063779 | N/A | N/A | 8147 | 8162 | CACAAGGCCTCTCATT | 78 | 1450 |
| 1063810 | N/A | N/A | 8658 | 8673 | CGAGAGAAGCTAAGTA | 71 | 1451 |
| 1063842 | N/A | N/A | 8879 | 8894 | GTGGAATAAGGCTGGC | 50 | 1452 |
| 1063874 | N/A | N/A | 9210 | 9225 | CTCACCACTTGAGCCT | 70 | 1453 |
| 1063906 | N/A | N/A | 9541 | 9556 | GCGCACTATCCCTATC | 74 | 1454 |
| 1063938 | N/A | N/A | 9790 | 9805 | GCTCACCACAGATGAA | 88 | 1455 |
| 1063970 | N/A | N/A | 10315 | 10330 | CTTTAACAACTCAGGA | 57 | 1456 |
| 1064002 | N/A | N/A | 10615 | 10630 | CTCTTTACCACCCAAC | 96 | 1457 |
| 1064034 | N/A | N/A | 11304 | 11319 | ATTCTTACCTGGGAAT | 110 | 1458 |
| 1064066 | N/A | N/A | 11458 | 11473 | AAGCTTTTGTGAGCGG | 79 | 1459 |
| 1064098 | N/A | N/A | 11583 | 11598 | GCCGAATATAGTAGCT | 70 | 1460 |

TABLE 23-continued

Inhibition of Foxp3 mRNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064132 | N/A | N/A | 11665 | 11680 | CGAATCCACCCCGATT | 114 | 1461 |
| 1064164 | N/A | N/A | 11773 | 11788 | AGGATGCAAGAGGTTA | 45 | 1462 |
| 1064196 | N/A | N/A | 11865 | 11880 | CTGACATAAGTTGTAT | 117 | 1463 |
| 1064228 | N/A | N/A | 11936 | 11951 | GTGAGTCTACAGGCCT | 46 | 1464 |
| 1064260 | N/A | N/A | 12021 | 12036 | GTGGAGGAACTCTGTC | 78* | 1465 |
| 1064292 | N/A | N/A | 12325 | 12340 | TCAGAATTTGGCATGC | 59 | 1466 |
| 1064324 | N/A | N/A | 12459 | 12474 | AGGAGTTAGAGTAAGA | 97 | 1467 |
| 1064356 | N/A | N/A | 12650 | 12665 | TAGGATGAAGGTTCTG | 84 | 1468 |
| 1064388 | N/A | N/A | 12848 | 12863 | GTTCGGTGTGGAGTGA | 82 | 1469 |
| 1064420 | N/A | N/A | 13017 | 13032 | GGGTTAAGAGTCAGGC | 12 | 1470 |
| 1064452 | N/A | N/A | 13246 | 13261 | GTGTGGGTATGGTTGT | 66 | 1471 |

TABLE 24

Inhibition of Foxp3 mRNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910950 | 1434 | 1449 | 13844 | 13859 | GCCTCTGGCTCCGTTT | 202 | 94 |
| 911144 | N/A | N/A | 7355 | 7370 | TGCTATGATCATCCCC | 30 | 65 |
| 1062020 | 50 | 65 | 450 | 465 | GTACGGTGTGGAAGCC | 41 | 1472 |
| 1062052 | 175 | 190 | 6713 | 6728 | ATCGGGTCCTTGTCCA | 37 | 1473 |
| 1062084 | 330 | 345 | 6868 | 6883 | CGCCTCGAAGATCTCG | 80 | 1474 |
| 1062116 | 490 | 505 | N/A | N/A | AGCTGGTGCATGAAAT | 104 | 1475 |
| 1062148 | 670 | 685 | 8247 | 8262 | GCCGGCTCCCTGGACA | 96 | 1476 |
| 1062180 | 811 | 826 | 8457 | 8472 | TCCTCTGGCTCTTCGA | 100 | 1477 |
| 1062212 | 999 | 1014 | N/A | N/A | CGGATGATGCCACAGA | 101 | 1478 |
| 1062244 | 1120 | 1135 | 11276 | 11291 | TGGCTACCCCACAGGT | 90 | 1479 |
| 1062276 | 1367 | 1382 | 13777 | 13792 | CACCCGCACAAAGCAC | 111 | 1480 |
| 1062308 | 1484 | 1499 | 13894 | 13909 | TCCTTGATCTTGAGGT | 113 | 1481 |
| 1062340 | 1790 | 1805 | 14200 | 14215 | GCGAGCAGCTGAGGCA | 70 | 1482 |
| 1062372 | 1906 | 1921 | 14316 | 14331 | GGTTGTTTGAGTGTAC | 9 | 1483 |
| 1062404 | 2077 | 2092 | 14487 | 14502 | TGGGACCTCAGATCCT | 72 | 1484 |
| 1062436 | 2284 | 2299 | N/A | N/A | CAGTCTAAGCTGAGGC | 42 | 1485 |
| 1062468 | N/A | N/A | 8331 | 8346 | ATAGGAGGGCGAGGAT | 114 | 1486 |
| 1062500 | N/A | N/A | 13647 | 13662 | TCCCCAATGTGCCTAT | 111 | 1487 |
| 1062532 | N/A | N/A | 645 | 660 | TACCAGAGGGCCCCTG | 99 | 1488 |
| 1062564 | N/A | N/A | 744 | 759 | TTAAGTACTTCACCTT | 56 | 1489 |
| 1062596 | N/A | N/A | 1006 | 1021 | ATGGCGGGAGAAAGAG | 36 | 1490 |

TABLE 24-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062628 | N/A | N/A | 1184 | 1199 | GCTCTAGGCTGGATGC | 107 | 1491 |
| 1062660 | N/A | N/A | 1294 | 1309 | GGCACCTTGCAATCCT | 36 | 1492 |
| 1062693 | N/A | N/A | 1398 | 1413 | TAAACTACGGTTGACA | 114 | 1493 |
| 1062725 | N/A | N/A | 1587 | 1602 | CCAATATATAGCATGA | 22 | 1494 |
| 1062757 | N/A | N/A | 1785 | 1800 | ATCCAAGGAAGCAGTC | 88 | 1495 |
| 1062789 | N/A | N/A | 1917 | 1932 | AATACTCACCTAGGGT | 79 | 1496 |
| 1062821 | N/A | N/A | 2107 | 2122 | GCAAATCAATAAGGGA | 40 | 1497 |
| 1062853 | N/A | N/A | 2313 | 2328 | GTAGGAAAGGACTTTC | 76 | 1498 |
| 1062885 | N/A | N/A | 2459 | 2474 | CACACATAGGGCTTGG | 26 | 1499 |
| 1062917 | N/A | N/A | 2638 | 2653 | ATAAGTTTTAACACCT | 56 | 1500 |
| 1062949 | N/A | N/A | 2803 | 2818 | ACTGGAGGACCATGGA | 115 | 1501 |
| 1062981 | N/A | N/A | 2987 | 3002 | TAAAGAAGGGCAAGGT | 81 | 1502 |
| 1063013 | N/A | N/A | 3180 | 3195 | AGGGATACATAGAGAC | 88 | 1503 |
| 1063045 | N/A | N/A | 3288 | 3303 | GAGTAGACAAGGGCCA | 82 | 1504 |
| 1063077 | N/A | N/A | 3540 | 3555 | GTCCAACCTGTGGGAA | 118 | 1505 |
| 1063109 | N/A | N/A | 3752 | 3767 | CCAATACAGAGCCCAT | 74 | 1506 |
| 1063141 | N/A | N/A | 3986 | 4001 | TCCTTGGAACCATCTG | 48 | 1507 |
| 1063173 | N/A | N/A | 4159 | 4174 | CTCCACAGATACTGGG | 65 | 1508 |
| 1063205 | N/A | N/A | 4368 | 4383 | GGGCAGATACCCCACC | 92 | 1509 |
| 1063236 | N/A | N/A | 4452 | 4467 | CCCGACTTGCCCAGAT | 67 | 1510 |
| 1063268 | N/A | N/A | 4661 | 4676 | AGCATAGATACATTCT | 32 | 1511 |
| 1063300 | N/A | N/A | 4805 | 4820 | TACCGATTTCGGTGCA | 71 | 1512 |
| 1063332 | N/A | N/A | 5162 | 5177 | TAAGTTCTTAGTCTCC | 24 | 1513 |
| 1063364 | N/A | N/A | 5422 | 5437 | ACTTGAGAACTCCACT | 100 | 1514 |
| 1063396 | N/A | N/A | 5611 | 5626 | GAAAGCCCTCCACAAT | 98 | 1515 |
| 1063428 | N/A | N/A | 5822 | 5837 | ATCCAGCATGGCAAGT | 79 | 1516 |
| 1063460 | N/A | N/A | 5935 | 5950 | GACATGAAGAGTCTGG | 58 | 1517 |
| 1063492 | N/A | N/A | 6037 | 6052 | CATGGGTTTTAGCTTG | 78 | 1518 |
| 1063524 | N/A | N/A | 6200 | 6215 | GAGGCTATTGTAACAG | 53 | 1519 |
| 1063556 | N/A | N/A | 6400 | 6415 | GAGGGCAATGGTTGTT | 38 | 1520 |
| 1063588 | N/A | N/A | 6635 | 6650 | CTCGACCACCTGAGCC | 133 | 1521 |
| 1063620 | N/A | N/A | 7036 | 7051 | AACCACTTCCTGTGCC | 85 | 1522 |
| 1063652 | N/A | N/A | 7310 | 7325 | GGAGATCGAGTAACTT | 22 | 1523 |
| 1063684 | N/A | N/A | 7558 | 7573 | CATACCTGGTGCATGA | 97 | 1524 |
| 1063716 | N/A | N/A | 7881 | 7896 | CTGCAATTCAGAATAG | 66 | 1525 |
| 1063748 | N/A | N/A | 8028 | 8043 | CGCAGGTGCTGACATT | 56 | 1526 |
| 1063780 | N/A | N/A | 8148 | 8163 | CCACAAGGCCTCTCAT | 149 | 1527 |
| 1063811 | N/A | N/A | 8659 | 8674 | TCGAGAGAAGCTAAGT | 112 | 1528 |

TABLE 24-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063843 | N/A | N/A | 8887 | 8902 | TGGGAACAGTGGAATA | 66 | 1529 |
| 1063875 | N/A | N/A | 9211 | 9226 | ACTCACCACTTGAGCC | 101 | 1530 |
| 1063907 | N/A | N/A | 9542 | 9557 | TGCGCACTATCCCTAT | 92 | 1531 |
| 1063939 | N/A | N/A | 9793 | 9808 | GTCGCTCACCACAGAT | 66 | 1532 |
| 1063971 | N/A | N/A | 10341 | 10356 | CTGGCAAGTCTGGCTA | 61 | 1533 |
| 1064003 | N/A | N/A | 10616 | 10631 | GCTCTTTACCACCCAA | 63 | 1534 |
| 1064035 | N/A | N/A | 11305 | 11320 | CATTCTTACCTGGGAA | 99 | 1535 |
| 1064067 | N/A | N/A | 11460 | 11475 | GGAAGCTTTTGTGAGC | 56 | 1536 |
| 1064099 | N/A | N/A | 11584 | 11599 | GGCCGAATATAGTAGC | 98 | 1537 |
| 1064133 | N/A | N/A | 11666 | 11681 | GCGAATCCACCCCGAT | 63 | 1538 |
| 1064165 | N/A | N/A | 11774 | 11789 | AAGGATGCAAGAGGTT | 78 | 1539 |
| 1064197 | N/A | N/A | 11866 | 11881 | CCTGACATAAGTTGTA | 86 | 1540 |
| 1064229 | N/A | N/A | 11941 | 11956 | ACAAGGTGAGTCTACA | 144 | 1541 |
| 1064261 | N/A | N/A | 12089 | 12104 | ACCCAGCGGATGAGCG | 39* | 1542 |
| 1064293 | N/A | N/A | 12326 | 12341 | GTCAGAATTTGGCATG | 75 | 1543 |
| 1064325 | N/A | N/A | 12460 | 12475 | AAGGAGTTAGAGTAAG | 171 | 1544 |
| 1064357 | N/A | N/A | 12651 | 12666 | CTAGGATGAAGGTTCT | 55 | 1545 |
| 1064389 | N/A | N/A | 12849 | 12864 | GGTTCGGTGTGGAGTG | 98 | 1546 |
| 1064421 | N/A | N/A | 13018 | 13033 | TGGGTTAAGAGTCAGG | 32 | 1547 |
| 1064453 | N/A | N/A | 13256 | 13271 | GGTTAGATGGGTGTGG | 82 | 1548 |

TABLE 25

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910950 | 1434 | 1449 | 13844 | 13859 | GCCTCTGGCTCCGTTT | 93 | 94 |
| 911144 | N/A | N/A | 7355 | 7370 | TGCTATGATCATCCCC | 49 | 65 |
| 1062021 | 51 | 66 | 451 | 466 | TGTACGGTGTGGAAGC | 40 | 1549 |
| 1062053 | 176 | 191 | 6714 | 6729 | CATCGGGTCCTTGTCC | 81 | 1550 |
| 1062085 | 331 | 346 | 6869 | 6884 | CCGCCTCGAAGATCTC | 67 | 1551 |
| 1062117 | 494 | 509 | N/A | N/A | TGAGAGCTGGTGCATG | 129 | 1552 |
| 1062149 | 672 | 687 | 8249 | 8264 | GTGCCGGCTCCCTGGA | 83 | 1553 |
| 1062181 | 816 | 831 | 8462 | 8477 | GGAAGTCCTCTGGCTC | 98 | 1554 |
| 1062213 | 1001 | 1016 | N/A | N/A | GTCGGATGATGCCACA | 85 | 1555 |
| 1062245 | 1124 | 1139 | 11280 | 11295 | TCCATGGCTACCCCAC | 115 | 1556 |
| 1062277 | 1368 | 1383 | 13778 | 13793 | CCACCCGCACAAAGCA | 114 | 1557 |
| 1062309 | 1485 | 1500 | 13895 | 13910 | TTCCTTGATCTTGAGG | 89 | 1558 |

TABLE 25-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062341 | 1791 | 1806 | 14201 | 14216 | TGCGAGCAGCTGAGGC | 72 | 1559 |
| 1062373 | 1907 | 1922 | 14317 | 14332 | AGGTTGTTTGAGTGTA | 8 | 1560 |
| 1062405 | 2078 | 2093 | 14488 | 14503 | TTGGGACCTCAGATCC | 72 | 1561 |
| 1062437 | 2285 | 2300 | N/A | N/A | GCAGTCTAAGCTGAGG | 66 | 1562 |
| 1062469 | N/A | N/A | 8332 | 8347 | GATAGGAGGGCGAGGA | 128 | 1563 |
| 1062501 | N/A | N/A | 13648 | 13663 | CTCCCCAATGTGCCTA | 87 | 1564 |
| 1062533 | N/A | N/A | 663 | 678 | GCTGGGTACATCCCAC | 127 | 1565 |
| 1062565 | N/A | N/A | 746 | 761 | CATTAAGTACTTCACC | 104 | 1566 |
| 1062597 | N/A | N/A | 1007 | 1022 | GATGGCGGGAGAAAGA | 96 | 1567 |
| 1062629 | N/A | N/A | 1185 | 1200 | AGCTCTAGGCTGGATG | 108 | 1568 |
| 1062661 | N/A | N/A | 1297 | 1312 | CCCGGCACCTTGCAAT | 87 | 1569 |
| 1062694 | N/A | N/A | 1399 | 1414 | CTAAACTACGGTTGAC | 107 | 1570 |
| 1062726 | N/A | N/A | 1613 | 1628 | GTTAATTGAATAAAGC | 113 | 1571 |
| 1062758 | N/A | N/A | 1797 | 1812 | CCCTTTTCAGGAATCC | 81 | 1572 |
| 1062790 | N/A | N/A | 1918 | 1933 | TAATACTCACCTAGGG | 99 | 1573 |
| 1062822 | N/A | N/A | 2109 | 2124 | TGGCAAATCAATAAGG | 95 | 1574 |
| 1062854 | N/A | N/A | 2316 | 2331 | CAAGTAGGAAAGGACT | 101 | 1575 |
| 1062886 | N/A | N/A | 2460 | 2475 | TCACACATAGGGCTTG | 59 | 1576 |
| 1062918 | N/A | N/A | 2649 | 2664 | CCATTCAAGATATAAG | 50 | 1577 |
| 1062950 | N/A | N/A | 2804 | 2819 | AACTGGAGGACCATGG | 115 | 1578 |
| 1062982 | N/A | N/A | 3017 | 3032 | TCAACTGATGCTGCCT | 53 | 1579 |
| 1063014 | N/A | N/A | 3181 | 3196 | TAGGGATACATAGAGA | 121 | 1580 |
| 1063046 | N/A | N/A | 3308 | 3323 | ACTGAGCACGGAGAGG | 100 | 1581 |
| 1063078 | N/A | N/A | 3562 | 3577 | CCCCACACTGTGATCG | 76 | 1582 |
| 1063110 | N/A | N/A | 3754 | 3769 | CGCCAATACAGAGCCC | 109 | 1583 |
| 1063142 | N/A | N/A | 3987 | 4002 | CTCCTTGGAACCATCT | 56 | 1584 |
| 1063174 | N/A | N/A | 4163 | 4178 | CAGGCTCCACAGATAC | 85 | 1585 |
| 1063206 | N/A | N/A | 4369 | 4384 | AGGGCAGATACCCCAC | 158 | 1586 |
| 1063237 | N/A | N/A | 4454 | 4469 | CCCCCGACTTGCCCAG | 32 | 1587 |
| 1063269 | N/A | N/A | 4662 | 4677 | AAGCATAGATACATTC | 69 | 1588 |
| 1063301 | N/A | N/A | 4806 | 4821 | ATACCGATTTCGGTGC | 119 | 1589 |
| 1063333 | N/A | N/A | 5163 | 5178 | TTAAGTTCTTAGTCTC | 39 | 1590 |
| 1063365 | N/A | N/A | 5423 | 5438 | GACTTGAGAACTCCAC | 110 | 1591 |
| 1063397 | N/A | N/A | 5613 | 5628 | TTGAAAGCCCTCCACA | 119 | 1592 |
| 1063429 | N/A | N/A | 5826 | 5841 | ACGGATCCAGCATGGC | 35 | 1593 |
| 1063461 | N/A | N/A | 5936 | 5951 | AGACATGAAGAGTCTG | 114 | 1594 |
| 1063493 | N/A | N/A | 6048 | 6063 | AGTCAAAGTGACATGG | 71 | 1595 |
| 1063525 | N/A | N/A | 6202 | 6217 | AGGAGGCTATTGTAAC | 85 | 1596 |

TABLE 25-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063557 | N/A | N/A | 6401 | 6416 | TGAGGGCAATGGTTGT | 79 | 1597 |
| 1063589 | N/A | N/A | 6636 | 6651 | ACTCGACCACCTGAGC | 140 | 1598 |
| 1063621 | N/A | N/A | 7043 | 7058 | ACCCAGAAACCACTTC | 112 | 1599 |
| 1063653 | N/A | N/A | 7311 | 7326 | TGGAGATCGAGTAACT | 23 | 1600 |
| 1063685 | N/A | N/A | 7559 | 7574 | CCATACCTGGTGCATG | 117 | 1601 |
| 1063717 | N/A | N/A | 7888 | 7903 | CAGAGTACTGCAATTC | 73 | 1602 |
| 1063749 | N/A | N/A | 8029 | 8044 | TCGCAGGTGCTGACAT | 97 | 1603 |
| 1063781 | N/A | N/A | 8185 | 8200 | ACCTATGGAGGCTGTG | 78 | 1604 |
| 1063812 | N/A | N/A | 8662 | 8677 | AGGTCGAGAGAAGCTA | 131 | 1605 |
| 1063844 | N/A | N/A | 8888 | 8903 | TTGGGAACAGTGGAAT | 119 | 1606 |
| 1063876 | N/A | N/A | 9228 | 9243 | CTGCATGTCAGGCCTG | 85 | 1607 |
| 1063908 | N/A | N/A | 9543 | 9558 | TTGCGCACTATCCCTA | 51 | 1608 |
| 1063940 | N/A | N/A | 9794 | 9809 | GGTCGCTCACCACAGA | 73 | 1609 |
| 1063972 | N/A | N/A | 10373 | 10388 | CATAGCTGGTCCTGCT | 61 | 1610 |
| 1064004 | N/A | N/A | 10621 | 10636 | ATAGGGCTCTTTACCA | 83 | 1611 |
| 1064036 | N/A | N/A | 11306 | 11321 | CCATTCTTACCTGGGA | 110 | 1612 |
| 1064068 | N/A | N/A | 11465 | 11480 | CGAAAGGAAGCTTTTG | 152 | 1613 |
| 1064100 | N/A | N/A | 11585 | 11600 | TGGCCGAATATAGTAG | 90 | 1614 |
| 1064134 | N/A | N/A | 11667 | 11682 | GGCGAATCCACCCCGA | 96 | 1615 |
| 1064166 | N/A | N/A | 11777 | 11792 | CCAAAGGATGCAAGAG | 115 | 1616 |
| 1064198 | N/A | N/A | 11867 | 11882 | ACCTGACATAAGTTGT | 119 | 1617 |
| 1064230 | N/A | N/A | 11942 | 11957 | TACAAGGTGAGTCTAC | 140 | 1618 |
| 1064262 | N/A | N/A | 12092 | 12107 | CTTACCCAGCGGATGA | 62 | 1619 |
| 1064294 | N/A | N/A | 12330 | 12345 | TAGGGTCAGAATTTGG | 60 | 1620 |
| 1064326 | N/A | N/A | 12461 | 12476 | GAAGGAGTTAGAGTAA | 140 | 1621 |
| 1064358 | N/A | N/A | 12652 | 12667 | GCTAGGATGAAGGTTC | 87 | 1622 |
| 1064390 | N/A | N/A | 12850 | 12865 | GGGTTCGGTGTGGAGT | 81 | 1623 |
| 1064422 | N/A | N/A | 13019 | 13034 | GTGGGTTAAGAGTCAG | 127 | 1624 |
| 1064454 | N/A | N/A | 13329 | 13344 | CAGGACTAGATGTGGG | 100 | 1625 |

TABLE 26

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910950 | 1434 | 1449 | 13844 | 13859 | GCCTCTGGCTCCGTTT | 179 | 94 |
| 911144 | N/A | N/A | 7355 | 7370 | TGCTATGATCATCCCC | 51 | 65 |
| 1062022 | 53 | 68 | 453 | 468 | GCTGTACGGTGTGGAA | 59 | 1626 |

TABLE 26-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062054 | 177 | 192 | 6715 | 6730 | GCATCGGGTCCTTGTC | 112 | 1627 |
| 1062086 | 332 | 347 | 6870 | 6885 | CCCGCCTCGAAGATCT | 31 | 1628 |
| 1062118 | 495 | 510 | N/A | N/A | TTGAGAGCTGGTGCAT | 153 | 1629 |
| 1062150 | 675 | 690 | 8252 | 8267 | GCAGTGCCGGCTCCCT | 45 | 1630 |
| 1062182 | 819 | 834 | 8465 | 8480 | TGAGGAAGTCCTCTGG | 124 | 1631 |
| 1062214 | 1002 | 1017 | N/A | N/A | TGTCGGATGATGCCAC | 56 | 1632 |
| 1062246 | 1141 | 1156 | N/A | N/A | TCTGGGAATGTGCTGT | 43 | 1633 |
| 1062278 | 1369 | 1384 | 13779 | 13794 | TCCACCCGCACAAAGC | 76 | 1634 |
| 1062310 | 1513 | 1528 | 13923 | 13938 | AGTTTGGCCCCTGTTC | 23 | 1635 |
| 1062342 | 1793 | 1808 | 14203 | 14218 | TGTGCGAGCAGCTGAG | 36 | 1636 |
| 1062374 | 1910 | 1925 | 14320 | 14335 | TTGAGGTTGTTTGAGT | 51 | 1637 |
| 1062406 | 2081 | 2096 | 14491 | 14506 | GTGTTGGGACCTCAGA | 42 | 1638 |
| 1062438 | 2296 | 2311 | N/A | N/A | GTAGTTCCTCTGCAGT | 59 | 1639 |
| 1062470 | N/A | N/A | 8333 | 8348 | GGATAGGAGGGCGAGG | 31 | 1640 |
| 1062502 | N/A | N/A | 13649 | 13664 | CCTCCCCAATGTGCCT | 56 | 1641 |
| 1062534 | N/A | N/A | 664 | 679 | AGCTGGGTACATCCCA | 106 | 1642 |
| 1062566 | N/A | N/A | 747 | 762 | GCATTAAGTACTTCAC | 22 | 1643 |
| 1062598 | N/A | N/A | 1009 | 1024 | CAGATGGCGGGAGAAA | 165 | 1644 |
| 1062630 | N/A | N/A | 1188 | 1203 | CAAAGCTCTAGGCTGG | 87 | 1645 |
| 1062662 | N/A | N/A | 1299 | 1314 | GCCCCGGCACCTTGCA | 46 | 1646 |
| 1062695 | N/A | N/A | 1400 | 1415 | GCTAAACTACGGTTGA | 40 | 1647 |
| 1062727 | N/A | N/A | 1630 | 1645 | GCTTCAAAAACACTAC | 104 | 1648 |
| 1062759 | N/A | N/A | 1803 | 1818 | GCAACTCCCTTTTCAG | 54 | 1649 |
| 1062791 | N/A | N/A | 1919 | 1934 | ATAATACTCACCTAGG | 49 | 1650 |
| 1062823 | N/A | N/A | 2110 | 2125 | GTGGCAAATCAATAAG | 32 | 1651 |
| 1062855 | N/A | N/A | 2337 | 2352 | GGTGAACATTTATCTC | 62 | 1652 |
| 1062887 | N/A | N/A | 2462 | 2477 | AATCACACATAGGGCT | 145 | 1653 |
| 1062919 | N/A | N/A | 2655 | 2670 | CCAGATCCATTCAAGA | 47 | 1654 |
| 1062951 | N/A | N/A | 2805 | 2820 | AAACTGGAGGACCATG | 95 | 1655 |
| 1062983 | N/A | N/A | 3018 | 3033 | TTCAACTGATGCTGCC | 72 | 1656 |
| 1063015 | N/A | N/A | 3182 | 3197 | ATAGGGATACATAGAG | 86 | 1657 |
| 1063047 | N/A | N/A | 3316 | 3331 | CCTTCTACACTGAGCA | 40 | 1658 |
| 1063079 | N/A | N/A | 3584 | 3599 | GCCCAGCTCTTGTGAG | 117 | 1659 |
| 1063111 | N/A | N/A | 3755 | 3770 | TCGCCAATACAGAGCC | 90 | 1660 |
| 1063143 | N/A | N/A | 3991 | 4006 | CAAACTCCTTGGAACC | 58 | 1661 |
| 1063175 | N/A | N/A | 4181 | 4196 | AGCTCTGAGAGTGCCA | 125 | 1662 |
| 1063207 | N/A | N/A | 4370 | 4385 | GAGGGCAGATACCCCA | 29 | 1663 |
| 1063238 | N/A | N/A | 4455 | 4470 | GCCCCGACTTGCCCA | 16 | 1664 |

TABLE 26-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063270 | N/A | N/A | 4665 | 4680 | GCAAAGCATAGATACA | 35 | 1665 |
| 1063302 | N/A | N/A | 4807 | 4822 | AATACCGATTTCGGTG | 129 | 1666 |
| 1063334 | N/A | N/A | 5164 | 5179 | ATTAAGTTCTTAGTCT | 82 | 1667 |
| 1063366 | N/A | N/A | 5424 | 5439 | TGACTTGAGAACTCCA | 136 | 1668 |
| 1063398 | N/A | N/A | 5614 | 5629 | CTTGAAAGCCCTCCAC | 133 | 1669 |
| 1063430 | N/A | N/A | 5827 | 5842 | CACGGATCCAGCATGG | 135 | 1670 |
| 1063462 | N/A | N/A | 5939 | 5954 | GATAGACATGAAGAGT | 65 | 1671 |
| 1063494 | N/A | N/A | 6075 | 6090 | AGCTTGGATGTAGTGG | 88 | 1672 |
| 1063526 | N/A | N/A | 6203 | 6218 | GAGGAGGCTATTGTAA | 87 | 1673 |
| 1063558 | N/A | N/A | 6402 | 6417 | ATGAGGGCAATGGTTG | 42 | 1674 |
| 1063590 | N/A | N/A | 6637 | 6652 | TACTCGACCACCTGAG | 101 | 1675 |
| 1063622 | N/A | N/A | 7056 | 7071 | AGACTTGCCTGGGACC | 135 | 1676 |
| 1063654 | N/A | N/A | 7312 | 7327 | ATGGAGATCGAGTAAC | 13 | 1677 |
| 1063686 | N/A | N/A | 7560 | 7575 | TCCATACCTGGTGCAT | 73 | 1678 |
| 1063718 | N/A | N/A | 7906 | 7921 | CCTGACACCTTTGACC | 49 | 1679 |
| 1063750 | N/A | N/A | 8030 | 8045 | TTCGCAGGTGCTGACA | 64 | 1680 |
| 1063782 | N/A | N/A | 8212 | 8227 | GTTGATCCCTGTGGGT | 54 | 1681 |
| 1063813 | N/A | N/A | 8680 | 8695 | ATACATACGAGAAAAC | 59 | 1682 |
| 1063845 | N/A | N/A | 8892 | 8907 | AACTTTGGGAACAGTG | 71 | 1683 |
| 1063877 | N/A | N/A | 9251 | 9266 | TAACACATGCCCCTCA | 98 | 1684 |
| 1063909 | N/A | N/A | 9545 | 9560 | TTTTGCGCACTATCCC | 86 | 1685 |
| 1063941 | N/A | N/A | 9820 | 9835 | TCTGAGTCTGCCACCA | 35 | 1686 |
| 1063973 | N/A | N/A | 10374 | 10389 | ACATAGCTGGTCCTGC | 35 | 1687 |
| 1064005 | N/A | N/A | 10622 | 10637 | AATAGGGCTCTTTACC | 55 | 1688 |
| 1064037 | N/A | N/A | 11308 | 11323 | GACCATTCTTACCTGG | 58 | 1689 |
| 1064069 | N/A | N/A | 11466 | 11481 | CCGAAAGGAAGCTTTT | 95 | 1690 |
| 1064102 | N/A | N/A | 11592 | 11607 | CTTCTGATGGCCGAAT | 86 | 1691 |
| 1064135 | N/A | N/A | 11668 | 11683 | GGGCGAATCCACCCCG | 81 | 1692 |
| 1064167 | N/A | N/A | 11778 | 11793 | ACCAAAGGATGCAAGA | 136 | 1693 |
| 1064199 | N/A | N/A | 11868 | 11883 | CACCTGACATAAGTTG | 195 | 1694 |
| 1064231 | N/A | N/A | 11943 | 11958 | CTACAAGGTGAGTCTA | 56 | 1695 |
| 1064263 | N/A | N/A | 12093 | 12108 | GCTTACCCAGCGGATG | 165* | 1696 |
| 1064295 | N/A | N/A | 12331 | 12346 | TTAGGGTCAGAATTTG | 155 | 1697 |
| 1064327 | N/A | N/A | 12462 | 12477 | GGAAGGAGTTAGAGTA | 129 | 1698 |
| 1064359 | N/A | N/A | 12653 | 12668 | CGCTAGGATGAAGGTT | 126 | 1699 |
| 1064391 | N/A | N/A | 12864 | 12879 | TGAGGTTAGTTGTGGG | 22 | 1700 |

TABLE 26-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064423 | N/A | N/A | 13020 | 13035 | GGTGGGTTAAGAGTCA | 141 | 1701 |
| 1064455 | N/A | N/A | 13330 | 13345 | ACAGGACTAGATGTGG | 65 | 1702 |

TABLE 27

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 582998 | N/A | N/A | 8468 | 8483 | ACTTGAGGAAGTCCTC | 105 | 1703 |
| 910950 | 1434 | 1449 | 13844 | 13859 | GCCTCTGGCTCCGTTT | 90 | 94 |
| 911144 | N/A | N/A | 7355 | 7370 | TGCTATGATCATCCCC | 28 | 65 |
| 1062023 | 56 | 71 | 456 | 471 | CACGCTGTACGGTGTG | 104 | 1704 |
| 1062055 | 204 | 219 | 6742 | 6757 | CCGAGGGCTTGCCAGG | 94 | 1705 |
| 1062087 | 333 | 348 | 6871 | 6886 | CCCCGCCTCGAAGATC | 28 | 1706 |
| 1062119 | 496 | 511 | N/A | N/A | GTTGAGAGCTGGTGCA | 82 | 1707 |
| 1062151 | 680 | 695 | 8257 | 8272 | GCAGAGCAGTGCCGGC | 82 | 1708 |
| 1062183 | 820 | 835 | 8466 | 8481 | TTGAGGAAGTCCTCTG | 56 | 1709 |
| 1062215 | 1003 | 1018 | N/A | N/A | TTGTCGGATGATGCCA | 75 | 1710 |
| 1062247 | 1151 | 1166 | N/A | N/A | GTGGAGGAACTCTGGG | 26 | 1711 |
| 1062279 | 1370 | 1385 | 13780 | 13795 | CTCCACCCGCACAAAG | 54 | 1712 |
| 1062311 | 1514 | 1529 | 13924 | 13939 | CAGTTTGGCCCCTGTT | 59 | 1713 |
| 1062343 | 1794 | 1809 | 14204 | 14219 | CTGTGCGAGCAGCTGA | 57 | 1714 |
| 1062375 | 1913 | 1928 | 14323 | 14338 | GCTTTGAGGTTGTTTG | 22 | 1715 |
| 1062407 | 2082 | 2097 | 14492 | 14507 | CGTGTTGGGACCTCAG | 22 | 1716 |
| 1062439 | 2298 | 2313 | N/A | N/A | GAGTAGTTCCTCTGCA | 32 | 1717 |
| 1062471 | N/A | N/A | 8354 | 8369 | GACAGAGGGTGTCAGG | 114 | 1718 |
| 1062503 | N/A | N/A | 13650 | 13665 | TCCTCCCCAATGTGCC | 57 | 1719 |
| 1062535 | N/A | N/A | 666 | 681 | GTAGCTGGGTACATCC | 46 | 1720 |
| 1062567 | N/A | N/A | 753 | 768 | GCCCATGCATTAAGTA | 83 | 1721 |
| 1062599 | N/A | N/A | 1010 | 1025 | ACAGATGGCGGGAGAA | 123 | 1722 |
| 1062631 | N/A | N/A | 1189 | 1204 | ACAAAGCTCTAGGCTG | 92 | 1723 |
| 1062663 | N/A | N/A | 1312 | 1327 | AAGTGCTCAGCTTGCC | 70 | 1724 |
| 1062696 | N/A | N/A | 1401 | 1416 | AGCTAAACTACGGTTG | 76 | 1725 |
| 1062728 | N/A | N/A | 1683 | 1698 | GAGGACAGTCTTGTCC | 96 | 1726 |
| 1062760 | N/A | N/A | 1821 | 1836 | CACGCCCCTTTGCCC | 27 | 1727 |
| 1062792 | N/A | N/A | 1920 | 1935 | AATAATACTCACCTAG | 111 | 1728 |
| 1062824 | N/A | N/A | 2113 | 2128 | GCTGTGGCAAATCAAT | 59 | 1729 |
| 1062856 | N/A | N/A | 2341 | 2356 | CATAGGTGAACATTTA | 47 | 1730 |

TABLE 27-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062888 | N/A | N/A | 2478 | 2493 | TAAGTGCCTGGCTAAA | 70 | 1731 |
| 1062920 | N/A | N/A | 2656 | 2671 | CCCAGATCCATTCAAG | 48 | 1732 |
| 1062952 | N/A | N/A | 2806 | 2821 | CAAACTGGAGGACCAT | 113 | 1733 |
| 1062984 | N/A | N/A | 3019 | 3034 | GTTCAACTGATGCTGC | 41 | 1734 |
| 1063016 | N/A | N/A | 3183 | 3198 | GATAGGGATACATAGA | 92 | 1735 |
| 1063048 | N/A | N/A | 3317 | 3332 | CCCTTCTACACTGAGC | 48 | 1736 |
| 1063080 | N/A | N/A | 3591 | 3606 | TCACCTAGCCCAGCTC | 75 | 1737 |
| 1063112 | N/A | N/A | 3756 | 3771 | TTCGCCAATACAGAGC | 47 | 1738 |
| 1063144 | N/A | N/A | 3994 | 4009 | GTCCAAACTCCTTGGA | 104 | 1739 |
| 1063176 | N/A | N/A | 4189 | 4204 | AGGTTTGAAGCTCTGA | 33 | 1740 |
| 1063208 | N/A | N/A | 4371 | 4386 | AGAGGGCAGATACCCC | 83 | 1741 |
| 1063239 | N/A | N/A | 4456 | 4471 | AGCCCCGACTTGCCC | 44 | 1742 |
| 1063271 | N/A | N/A | 4666 | 4681 | AGCAAAGCATAGATAC | 49 | 1743 |
| 1063303 | N/A | N/A | 4808 | 4823 | TAATACCGATTTCGGT | 110 | 1744 |
| 1063335 | N/A | N/A | 5165 | 5180 | TATTAAGTTCTTAGTC | 47 | 1745 |
| 1063367 | N/A | N/A | 5426 | 5441 | AGTGACTTGAGAACTC | 67 | 1746 |
| 1063399 | N/A | N/A | 5616 | 5631 | ACCTTGAAAGCCCTCC | 28 | 1747 |
| 1063431 | N/A | N/A | 5828 | 5843 | GCACGGATCCAGCATG | 85 | 1748 |
| 1063463 | N/A | N/A | 5942 | 5957 | GTAGATAGACATGAAG | 59 | 1749 |
| 1063495 | N/A | N/A | 6076 | 6091 | CAGCTTGGATGTAGTG | 55 | 1750 |
| 1063527 | N/A | N/A | 6235 | 6250 | AGATTCATCTGGCTGC | 46 | 1751 |
| 1063559 | N/A | N/A | 6403 | 6418 | TATGAGGGCAATGGTT | 77 | 1752 |
| 1063591 | N/A | N/A | 6638 | 6653 | ATACTCGACCACCTGA | 76 | 1753 |
| 1063623 | N/A | N/A | 7060 | 7075 | TCACAGACTTGCCTGG | 83 | 1754 |
| 1063655 | N/A | N/A | 7331 | 7346 | CGTATGGAAACTGAGG | 19 | 1755 |
| 1063687 | N/A | N/A | 7562 | 7577 | CGTCCATACCTGGTGC | 94 | 1756 |
| 1063719 | N/A | N/A | 7907 | 7922 | ACCTGACACCTTTGAC | 89 | 1757 |
| 1063751 | N/A | N/A | 8031 | 8046 | ATTCGCAGGTGCTGAC | 64 | 1758 |
| 1063814 | N/A | N/A | 8682 | 8697 | TTATACATACGAGAAA | 108 | 1759 |
| 1063846 | N/A | N/A | 8895 | 8910 | TAGAACTTTGGGAACA | 73 | 1760 |
| 1063878 | N/A | N/A | 9253 | 9268 | CTTAACACATGCCCCT | 82 | 1761 |
| 1063910 | N/A | N/A | 9551 | 9566 | AGAAGGTTTTGCGCAC | 20 | 1762 |
| 1063942 | N/A | N/A | 9866 | 9881 | GTTAGGTTCCCTGCAC | 68 | 1763 |
| 1063974 | N/A | N/A | 10375 | 10390 | TACATAGCTGGTCCTG | 34 | 1764 |
| 1064006 | N/A | N/A | 10623 | 10638 | GAATAGGGCTCTTTAC | 87 | 1765 |
| 1064038 | N/A | N/A | 11309 | 11324 | GGACCATTCTTACCTG | 104 | 1766 |
| 1064070 | N/A | N/A | 11467 | 11482 | CCCGAAAGGAAGCTTT | 65 | 1767 |
| 1064103 | N/A | N/A | 11594 | 11609 | CCCTTCTGATGGCCGA | 28 | 1768 |

TABLE 27-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
| --- | --- | --- | --- | --- | --- | --- | --- |
| 1064136 | N/A | N/A | 11669 | 11684 | CGGGCGAATCCACCCC | 110 | 1769 |
| 1064168 | N/A | N/A | 11779 | 11794 | CACCAAAGGATGCAAG | 109 | 1770 |
| 1064200 | N/A | N/A | 11869 | 11884 | GCACCTGACATAAGTT | 77 | 1771 |
| 1064232 | N/A | N/A | 11944 | 11959 | CCTACAAGGTGAGTCT | 100 | 1772 |
| 1064264 | N/A | N/A | 12094 | 12109 | TGCTTACCCAGCGGAT | 107* | 1773 |
| 1064296 | N/A | N/A | 12333 | 12348 | GTTTAGGGTCAGAATT | 105 | 1774 |
| 1064328 | N/A | N/A | 12463 | 12478 | GGGAAGGAGTTAGAGT | 107 | 1775 |
| 1064360 | N/A | N/A | 12654 | 12669 | GCGCTAGGATGAAGGT | 102 | 1776 |
| 1064392 | N/A | N/A | 12866 | 12881 | GATGAGGTTAGTTGTG | 93 | 1777 |
| 1064424 | N/A | N/A | 13041 | 13056 | CAACTTAAGGGTCAGG | 86 | 1778 |
| 1064456 | N/A | N/A | 13331 | 13346 | GACAGGACTAGATGTG | 91 | 1779 |

TABLE 28

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
| --- | --- | --- | --- | --- | --- | --- | --- |
| 910950 | 1434 | 1449 | 13844 | 13859 | GCCTCTGGCTCCGTTT | 90 | 94 |
| 911144 | N/A | N/A | 7355 | 7370 | TGCTATGATCATCCCC | 39 | 65 |
| 1062024 | 58 | 73 | 458 | 473 | ACCACGCTGTACGGTG | 92 | 1780 |
| 1062056 | 205 | 220 | 6743 | 6758 | GCCGAGGGCTTGCCAG | 103 | 1781 |
| 1062088 | 334 | 349 | 6872 | 6887 | GCCCCGCCTCGAAGAT | 56 | 1782 |
| 1062120 | 498 | 513 | N/A | N/A | CCGTTGAGAGCTGGTG | 68 | 1783 |
| 1062152 | 682 | 697 | 8259 | 8274 | GTGCAGAGCAGTGCCG | 78 | 1784 |
| 1062184 | 822 | 837 | N/A | N/A | GCTTGAGGAAGTCCTC | 79 | 1785 |
| 1062216 | 1004 | 1019 | 11160 | 11175 | CTTGTCGGATGATGCC | 49 | 1786 |
| 1062248 | 1157 | 1172 | 12027 | 12042 | CATGTTGTGGAGGAAC | 69 | 1787 |
| 1062280 | 1372 | 1387 | 13782 | 13797 | CTCTCCACCCGCACAA | 67 | 1788 |
| 1062312 | 1515 | 1530 | 13925 | 13940 | CCAGTTTGGCCCCTGT | 88 | 1789 |
| 1062344 | 1795 | 1810 | 14205 | 14220 | TCTGTGCGAGCAGCTG | 43 | 1790 |
| 1062376 | 1915 | 1930 | 14325 | 14340 | CAGCTTTGAGGTTGTT | 30 | 1791 |
| 1062408 | 2105 | 2120 | 14515 | 14530 | CAGGCCGTGTGTGTGA | 64 | 1792 |
| 1062440 | 2299 | 2314 | N/A | N/A | TGAGTAGTTCCTCTGC | 56 | 1793 |
| 1062472 | N/A | N/A | 13560 | 13575 | GAGGAGCTCACCTTCC | 106 | 1794 |
| 1062504 | N/A | N/A | 13655 | 13670 | CCCGTTCCTCCCCAAT | 34 | 1795 |
| 1062536 | N/A | N/A | 668 | 683 | CGGTAGCTGGGTACAT | 36 | 1796 |
| 1062568 | N/A | N/A | 755 | 770 | CTGCCCATGCATTAAG | 70 | 1797 |
| 1062600 | N/A | N/A | 1011 | 1026 | GACAGATGGCGGGAGA | 98 | 1798 |

TABLE 28-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062632 | N/A | N/A | 1190 | 1205 | TACAAAGCTCTAGGCT | 82 | 1799 |
| 1062664 | N/A | N/A | 1314 | 1329 | TTAAGTGCTCAGCTTG | 77 | 1800 |
| 1062697 | N/A | N/A | 1402 | 1417 | CAGCTAAACTACGGTT | 86 | 1801 |
| 1062729 | N/A | N/A | 1684 | 1699 | TGAGGACAGTCTTGTC | 69 | 1802 |
| 1062761 | N/A | N/A | 1827 | 1842 | AAAATGCACGCCCCCT | 36 | 1803 |
| 1062793 | N/A | N/A | 1997 | 2012 | GTAATCACAAGATGCA | 56 | 1804 |
| 1062825 | N/A | N/A | 2120 | 2135 | ATAAAGAGCTGTGGCA | 81 | 1805 |
| 1062857 | N/A | N/A | 2345 | 2360 | CCAACATAGGTGAACA | 2 | 1806 |
| 1062889 | N/A | N/A | 2479 | 2494 | TTAAGTGCCTGGCTAA | 73 | 1807 |
| 1062921 | N/A | N/A | 2668 | 2683 | TACCCTAAAATGCCCA | 55 | 1808 |
| 1062953 | N/A | N/A | 2807 | 2822 | TCAAACTGGAGGACCA | 112 | 1809 |
| 1062985 | N/A | N/A | 3024 | 3039 | GGCTGGTTCAACTGAT | 50 | 1810 |
| 1063017 | N/A | N/A | 3184 | 3199 | AGATAGGGATACATAG | 89 | 1811 |
| 1063049 | N/A | N/A | 3318 | 3333 | GCCCTTCTACACTGAG | 32 | 1812 |
| 1063081 | N/A | N/A | 3592 | 3607 | CTCACCTAGCCCAGCT | 103 | 1813 |
| 1063113 | N/A | N/A | 3757 | 3772 | CTTCGCCAATACAGAG | 74 | 1814 |
| 1063145 | N/A | N/A | 4023 | 4038 | CTCAGTATGTGTAGGC | 35 | 1815 |
| 1063177 | N/A | N/A | 4190 | 4205 | CAGGTTTGAAGCTCTG | 73 | 1816 |
| 1063209 | N/A | N/A | 4372 | 4387 | AAGAGGGCAGATACCC | 81 | 1817 |
| 1063240 | N/A | N/A | 4457 | 4472 | CAGCCCCCGACTTGCC | 65 | 1818 |
| 1063272 | N/A | N/A | 4668 | 4683 | TCAGCAAAGCATAGAT | 77 | 1819 |
| 1063304 | N/A | N/A | 4809 | 4824 | CTAATACCGATTTCGG | 93 | 1820 |
| 1063336 | N/A | N/A | 5166 | 5181 | GTATTAAGTTCTTAGT | 71 | 1821 |
| 1063368 | N/A | N/A | 5428 | 5443 | ATAGTGACTTGAGAAC | 101 | 1822 |
| 1063400 | N/A | N/A | 5617 | 5632 | CACCTTGAAAGCCCTC | 35 | 1823 |
| 1063432 | N/A | N/A | 5829 | 5844 | TGCACGGATCCAGCAT | 123 | 1824 |
| 1063464 | N/A | N/A | 5943 | 5958 | TGTAGATAGACATGAA | 67 | 1825 |
| 1063496 | N/A | N/A | 6094 | 6109 | GATCAGGAGCAGTGCT | 93 | 1826 |
| 1063528 | N/A | N/A | 6251 | 6266 | TAGGCATGGACTCAAA | 78 | 1827 |
| 1063560 | N/A | N/A | 6404 | 6419 | CTATGAGGGCAATGGT | 82 | 1828 |
| 1063592 | N/A | N/A | 6639 | 6654 | GATACTCGACCACCTG | 66 | 1829 |
| 1063624 | N/A | N/A | 7066 | 7081 | CATAAGTCACAGACTT | 93 | 1830 |
| 1063656 | N/A | N/A | 7352 | 7367 | TATGATCATCCCCCTT | 73 | 1831 |
| 1063688 | N/A | N/A | 7563 | 7578 | CCGTCCATACCTGGTG | 89 | 1832 |
| 1063720 | N/A | N/A | 7908 | 7923 | GACCTGACACCTTTGA | 60 | 1833 |
| 1063752 | N/A | N/A | 8032 | 8047 | CATTCGCAGGTGCTGA | 70 | 1834 |
| 1063783 | N/A | N/A | 8469 | 8484 | CACTTGAGGAAGTCCT | 92 | 1835 |
| 1063815 | N/A | N/A | 8683 | 8698 | ATTATACATACGAGAA | 90 | 1836 |

TABLE 28-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063847 | N/A | N/A | 8899 | 8914 | GAGCTAGAACTTTGGG | 80 | 1837 |
| 1063879 | N/A | N/A | 9254 | 9269 | CCTTAACACATGCCCC | 59 | 1838 |
| 1063911 | N/A | N/A | 9553 | 9568 | ACAGAAGGTTTTGCGC | 57 | 1839 |
| 1063943 | N/A | N/A | 9867 | 9882 | GGTTAGGTTCCCTGCA | 56 | 1840 |
| 1063975 | N/A | N/A | 10376 | 10391 | TTACATAGCTGGTCCT | 36 | 1841 |
| 1064007 | N/A | N/A | 10624 | 10639 | TGAATAGGGCTCTTTA | 84 | 1842 |
| 1064039 | N/A | N/A | 11311 | 11326 | AAGGACCATTCTTACC | 135 | 1843 |
| 1064071 | N/A | N/A | 11468 | 11483 | TCCCGAAAGGAAGCTT | 64 | 1844 |
| 1064105 | N/A | N/A | 11602 | 11617 | GGGTCCCTCCCTTCTG | 69 | 1845 |
| 1064137 | N/A | N/A | 11670 | 11685 | TCGGGCGAATCCACCC | 88 | 1846 |
| 1064169 | N/A | N/A | 11782 | 11797 | GCACACCAAAGGATGC | 110 | 1847 |
| 1064201 | N/A | N/A | 11870 | 11885 | AGCACCTGACATAAGT | 81 | 1848 |
| 1064233 | N/A | N/A | 11945 | 11960 | CCCTACAAGGTGAGTC | 79 | 1849 |
| 1064265 | N/A | N/A | 12095 | 12110 | CTGCTTACCCAGCGGA | 93* | 1850 |
| 1064297 | N/A | N/A | 12334 | 12349 | GGTTTAGGGTCAGAAT | 51 | 1851 |
| 1064329 | N/A | N/A | 12477 | 12492 | TGGCATAAAGGCTGGG | 48 | 1852 |
| 1064361 | N/A | N/A | 12682 | 12697 | GTGAGGTTCAGGTTTG | 54 | 1853 |
| 1064393 | N/A | N/A | 12867 | 12882 | GGATGAGGTTAGTTGT | 98 | 1854 |
| 1064425 | N/A | N/A | 13043 | 13058 | GCCAACTTAAGGGTCA | 68 | 1855 |
| 1064457 | N/A | N/A | 13332 | 13347 | GGACAGGACTAGATGT | 91 | 1856 |

TABLE 29

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910950 | 1434 | 1449 | 13844 | 13859 | GCCTCTGGCTCCGTTT | 143 | 94 |
| 911144 | N/A | N/A | 7355 | 7370 | TGCTATGATCATCCCC | 53 | 65 |
| 1062025 | 60 | 75 | 460 | 475 | AAACCACGCTGTACGG | 143 | 1857 |
| 1062057 | 206 | 221 | 6744 | 6759 | GGCCGAGGGCTTGCCA | 88 | 1858 |
| 1062089 | 337 | 352 | 6875 | 6890 | TGGGCCCCGCCTCGAA | 232 | 1859 |
| 1062121 | 499 | 514 | N/A | N/A | ACCGTTGAGAGCTGGT | 423 | 1860 |
| 1062153 | 693 | 708 | 8270 | 8285 | GATTTGGGAAGGTGCA | 138 | 1861 |
| 1062185 | 824 | 839 | N/A | N/A | GTGCTTGAGGAAGTCC | 305 | 1862 |
| 1062217 | 1006 | 1021 | 11162 | 11177 | CCCTTGTCGGATGATG | 97 | 1863 |
| 1062249 | 1159 | 1174 | 12029 | 12044 | TCCATGTTGTGGAGGA | 448* | 1864 |
| 1062281 | 1376 | 1391 | 13786 | 13801 | CTCGCTCTCCACCCGC | 69 | 1865 |
| 1062313 | 1516 | 1531 | 13926 | 13941 | ACCAGTTTGGCCCCTG | 127 | 1866 |

TABLE 29-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062345 | 1796 | 1811 | 14206 | 14221 | ATCTGTGCGAGCAGCT | 69 | 1867 |
| 1062377 | 1917 | 1932 | 14327 | 14342 | TGCAGCTTTGAGGTTG | 52 | 1868 |
| 1062409 | 2107 | 2122 | 14517 | 14532 | AACAGGCCGTGTGTGT | 67 | 1869 |
| 1062441 | 2300 | 2315 | N/A | N/A | ATGAGTAGTTCCTCTG | 47 | 1870 |
| 1062473 | N/A | N/A | 13561 | 13576 | AGAGGAGCTCACCTTC | 139 | 1871 |
| 1062505 | N/A | N/A | 13656 | 13671 | TCCCGTTCCTCCCCAA | 110 | 1872 |
| 1062537 | N/A | N/A | 669 | 684 | ACGGTAGCTGGGTACA | 141 | 1873 |
| 1062569 | N/A | N/A | 785 | 800 | ATCAATTGATGAATTC | 64 | 1874 |
| 1062601 | N/A | N/A | 1012 | 1027 | AGACAGATGGCGGGAG | 71 | 1875 |
| 1062633 | N/A | N/A | 1191 | 1206 | GTACAAAGCTCTAGGC | 40 | 1876 |
| 1062665 | N/A | N/A | 1315 | 1330 | GTTAAGTGCTCAGCTT | 146 | 1877 |
| 1062698 | N/A | N/A | 1409 | 1424 | GTCCACACAGCTAAAC | 75 | 1878 |
| 1062730 | N/A | N/A | 1686 | 1701 | TGTGAGGACAGTCTTG | 520 | 1879 |
| 1062762 | N/A | N/A | 1829 | 1844 | TAAAATGCACGCCCC | 70 | 1880 |
| 1062794 | N/A | N/A | 1998 | 2013 | AGTAATCACAAGATGC | 201 | 1881 |
| 1062826 | N/A | N/A | 2121 | 2136 | AATAAAGAGCTGTGGC | 144 | 1882 |
| 1062858 | N/A | N/A | 2346 | 2361 | GCCAACATAGGTGAAC | 147 | 1883 |
| 1062890 | N/A | N/A | 2480 | 2495 | GTTAAGTGCCTGGCTA | 59 | 1884 |
| 1062922 | N/A | N/A | 2670 | 2685 | TATACCCTAAAATGCC | 63 | 1885 |
| 1062954 | N/A | N/A | 2808 | 2823 | TTCAAACTGGAGGACC | 166 | 1886 |
| 1062986 | N/A | N/A | 3026 | 3041 | CTGGCTGGTTCAACTG | 65 | 1887 |
| 1063018 | N/A | N/A | 3185 | 3200 | GAGATAGGGATACATA | 149 | 1888 |
| 1063050 | N/A | N/A | 3323 | 3338 | AATTTGCCCTTCTACA | 98 | 1889 |
| 1063082 | N/A | N/A | 3610 | 3625 | ACCTATGGAGTCCGGG | 57 | 1890 |
| 1063114 | N/A | N/A | 3758 | 3773 | CCTTCGCCAATACAGA | 410 | 1891 |
| 1063146 | N/A | N/A | 4024 | 4039 | TCTCAGTATGTGTAGG | 57 | 1892 |
| 1063178 | N/A | N/A | 4191 | 4206 | CCAGGTTTGAAGCTCT | 33 | 1893 |
| 1063210 | N/A | N/A | 4373 | 4388 | GAAGAGGGCAGATACC | 239 | 1894 |
| 1063241 | N/A | N/A | 4460 | 4475 | TCACAGCCCCCGACTT | 317 | 1895 |
| 1063273 | N/A | N/A | 4674 | 4689 | CCTGACTCAGCAAAGC | 238 | 1896 |
| 1063305 | N/A | N/A | 4810 | 4825 | ACTAATACCGATTTCG | 97 | 1897 |
| 1063337 | N/A | N/A | 5169 | 5184 | CAGGTATTAAGTTCTT | 67 | 1898 |
| 1063369 | N/A | N/A | 5429 | 5444 | CATAGTGACTTGAGAA | 379 | 1899 |
| 1063401 | N/A | N/A | 5618 | 5633 | TCACCTTGAAAGCCCT | 67 | 1900 |
| 1063433 | N/A | N/A | 5830 | 5845 | ATGCACGGATCCAGCA | 76 | 1901 |
| 1063465 | N/A | N/A | 5956 | 5971 | GCAAAAGTGCAGGTGT | 127 | 1902 |
| 1063497 | N/A | N/A | 6097 | 6112 | CTGGATCAGGAGCAGT | 533 | 1903 |
| 1063529 | N/A | N/A | 6254 | 6269 | GACTAGGCATGGACTC | 62 | 1904 |

TABLE 29-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063561 | N/A | N/A | 6405 | 6420 | TCTATGAGGGCAATGG | 283 | 1905 |
| 1063593 | N/A | N/A | 6640 | 6655 | AGATACTCGACCACCT | 243 | 1906 |
| 1063625 | N/A | N/A | 7067 | 7082 | GCATAAGTCACAGACT | 121 | 1907 |
| 1063657 | N/A | N/A | 7354 | 7369 | GCTATGATCATCCCCC | 90 | 1908 |
| 1063689 | N/A | N/A | 7565 | 7580 | CACCGTCCATACCTGG | 461 | 1909 |
| 1063721 | N/A | N/A | 7909 | 7924 | AGACCTGACACCTTTG | 41 | 1910 |
| 1063753 | N/A | N/A | 8033 | 8048 | CCATTCGCAGGTGCTG | 164 | 1911 |
| 1063784 | N/A | N/A | 8470 | 8485 | TCACTTGAGGAAGTCC | 117 | 1912 |
| 1063816 | N/A | N/A | 8685 | 8700 | TTATTATACATACGAG | 214 | 1913 |
| 1063848 | N/A | N/A | 8900 | 8915 | GGAGCTAGAACTTTGG | 208 | 1914 |
| 1063880 | N/A | N/A | 9361 | 9376 | GCTCAATGCTCTGAAT | 93 | 1915 |
| 1063912 | N/A | N/A | 9554 | 9569 | GACAGAAGGTTTTGCG | 28 | 1916 |
| 1063944 | N/A | N/A | 9869 | 9884 | GAGGTTAGGTTCCCTG | 63 | 1917 |
| 1063976 | N/A | N/A | 10377 | 10392 | GTTACATAGCTGGTCC | 28 | 1918 |
| 1064008 | N/A | N/A | 10626 | 10641 | GTTGAATAGGGCTCTT | 51 | 1919 |
| 1064040 | N/A | N/A | 11312 | 11327 | CAAGGACCATTCTTAC | 78 | 1920 |
| 1064072 | N/A | N/A | 11469 | 11484 | ATCCCGAAAGGAAGCT | 68 | 1921 |
| 1064106 | N/A | N/A | 11607 | 11622 | TAGCAGGGTCCCTCCC | 177 | 1922 |
| 1064138 | N/A | N/A | 11671 | 11686 | CTCGGGCGAATCCACC | 74 | 1923 |
| 1064170 | N/A | N/A | 11790 | 11805 | AGTAACTTGCACACCA | 81 | 1924 |
| 1064202 | N/A | N/A | 11871 | 11886 | GAGCACCTGACATAAG | 215 | 1925 |
| 1064234 | N/A | N/A | 11946 | 11961 | CCCCTACAAGGTGAGT | 70 | 1926 |
| 1064266 | N/A | N/A | 12096 | 12111 | CCTGCTTACCCAGCGG | 62* | 1927 |
| 1064298 | N/A | N/A | 12336 | 12351 | TAGGTTTAGGGTCAGA | 27 | 1928 |
| 1064330 | N/A | N/A | 12478 | 12493 | TTGGCATAAAGGCTGG | 55 | 1929 |
| 1064362 | N/A | N/A | 12683 | 12698 | GGTGAGGTTCAGGTTT | 82 | 1930 |
| 1064394 | N/A | N/A | 12868 | 12883 | AGGATGAGGTTAGTTG | 199 | 1931 |
| 1064426 | N/A | N/A | 13044 | 13059 | GGCCAACTTAAGGGTC | 98 | 1932 |
| 1064458 | N/A | N/A | 13334 | 13349 | AGGGACAGGACTAGAT | 109 | 1933 |

TABLE 30

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910950 | 1434 | 1449 | 13844 | 13859 | GCCTCTGGCTCCGTTT | 162 | 94 |
| 911144 | N/A | N/A | 7355 | 7370 | TGCTATGATCATCCCC | 55 | 65 |
| 1062026 | 61 | 76 | 461 | 476 | AAAACCACGCTGTACG | 70 | 1934 |

TABLE 30-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062058 | 246 | 261 | 6784 | 6799 | TGGGCGAGGCTCCTGG | 70 | 1935 |
| 1062090 | 342 | 357 | 6880 | 6895 | AGGCATGGGCCCCGCC | 53 | 1936 |
| 1062122 | 501 | 516 | 7664 | 7679 | CCACCGTTGAGAGCTG | 140 | 1937 |
| 1062154 | 702 | 717 | 8279 | 8294 | GTGCACTGGGATTTGG | 82 | 1938 |
| 1062186 | 826 | 841 | N/A | N/A | CAGTGCTTGAGGAAGT | 51 | 1939 |
| 1062218 | 1007 | 1022 | 11163 | 11178 | GCCCTTGTCGGATGAT | 92 | 1940 |
| 1062250 | 1162 | 1177 | 12032 | 12047 | TAGTCCATGTTGTGGA | 49* | 1941 |
| 1062282 | 1377 | 1392 | 13787 | 13802 | TCTCGCTCTCCACCCG | 71 | 1942 |
| 1062314 | 1520 | 1535 | 13930 | 13945 | TCCCACCAGTTTGGCC | 104 | 1943 |
| 1062346 | 1797 | 1812 | 14207 | 14222 | AATCTGTGCGAGCAGC | 59 | 1944 |
| 1062378 | 1919 | 1934 | 14329 | 14344 | GATGCAGCTTTGAGGT | 19 | 1945 |
| 1062410 | 2115 | 2130 | 14525 | 14540 | TGAATTCTAACAGGCC | 40 | 1946 |
| 1062442 | 2318 | 2333 | N/A | N/A | GCCTTGGATCCCAAAT | 57 | 1947 |
| 1062474 | N/A | N/A | 13562 | 13577 | CAGAGGAGCTCACCTT | 131 | 1948 |
| 1062506 | N/A | N/A | 13658 | 13673 | CATCCCGTTCCTCCCC | 64 | 1949 |
| 1062538 | N/A | N/A | 670 | 685 | CACGGTAGCTGGGTAC | 108 | 1950 |
| 1062570 | N/A | N/A | 788 | 803 | CGTATCAATTGATGAA | 17 | 1951 |
| 1062602 | N/A | N/A | 1014 | 1029 | ACAGACAGATGGCGGG | 59 | 1952 |
| 1062634 | N/A | N/A | 1214 | 1229 | TACTATTATTAAACGC | 79 | 1953 |
| 1062666 | N/A | N/A | 1316 | 1331 | AGTTAAGTGCTCAGCT | 52 | 1954 |
| 1062699 | N/A | N/A | 1411 | 1426 | AGGTCCACACAGCTAA | 42 | 1955 |
| 1062731 | N/A | N/A | 1687 | 1702 | ATGTGAGGACAGTCTT | 117 | 1956 |
| 1062763 | N/A | N/A | 1830 | 1845 | TTAAAAATGCACGCCC | 95 | 1957 |
| 1062795 | N/A | N/A | 2014 | 2029 | GCCAATGAATAGTAAA | 110 | 1958 |
| 1062827 | N/A | N/A | 2125 | 2140 | TCCAAATAAAGAGCTG | 97 | 1959 |
| 1062859 | N/A | N/A | 2347 | 2362 | AGCCAACATAGGTGAA | 147 | 1960 |
| 1062891 | N/A | N/A | 2512 | 2527 | CAGTACATATGAGGAA | 19 | 1961 |
| 1062923 | N/A | N/A | 2672 | 2687 | CATATACCCTAAAATG | 220 | 1962 |
| 1062955 | N/A | N/A | 2809 | 2824 | TTTCAAACTGGAGGAC | 70 | 1963 |
| 1062987 | N/A | N/A | 3029 | 3044 | TCTCTGGCTGGTTCAA | 44 | 1964 |
| 1063019 | N/A | N/A | 3186 | 3201 | AGAGATAGGGATACAT | 134 | 1965 |
| 1063051 | N/A | N/A | 3324 | 3339 | CAATTTGCCCTTCTAC | 151 | 1966 |
| 1063083 | N/A | N/A | 3611 | 3626 | GACCTATGGAGTCCGG | 139 | 1967 |
| 1063115 | N/A | N/A | 3759 | 3774 | GCCTTCGCCAATACAG | 54 | 1968 |
| 1063147 | N/A | N/A | 4032 | 4047 | TCCCAAAGTCTCAGTA | 100 | 1969 |
| 1063179 | N/A | N/A | 4192 | 4207 | CCCAGGTTTGAAGCTC | 117 | 1970 |
| 1063211 | N/A | N/A | 4374 | 4389 | AGAAGAGGGCAGATAC | 157 | 1971 |
| 1063242 | N/A | N/A | 4462 | 4477 | TGTCACAGCCCCCGAC | 86 | 1972 |

TABLE 30-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063274 | N/A | N/A | 4683 | 4698 | GTGGGATGGCCTGACT | 148 | 1973 |
| 1063306 | N/A | N/A | 4811 | 4826 | AACTAATACCGATTTC | 129 | 1974 |
| 1063338 | N/A | N/A | 5170 | 5185 | CCAGGTATTAAGTTCT | 49 | 1975 |
| 1063370 | N/A | N/A | 5430 | 5445 | CCATAGTGACTTGAGA | 213 | 1976 |
| 1063402 | N/A | N/A | 5619 | 5634 | CTCACCTTGAAAGCCC | 85 | 1977 |
| 1063434 | N/A | N/A | 5833 | 5848 | ATCATGCACGGATCCA | 154 | 1978 |
| 1063466 | N/A | N/A | 5957 | 5972 | TGCAAAAGTGCAGGTG | 55 | 1979 |
| 1063498 | N/A | N/A | 6104 | 6119 | TCTGAAGCTGGATCAG | 151 | 1980 |
| 1063530 | N/A | N/A | 6255 | 6270 | TGACTAGGCATGGACT | 173 | 1981 |
| 1063562 | N/A | N/A | 6407 | 6422 | CCTCTATGAGGGCAAT | 237 | 1982 |
| 1063594 | N/A | N/A | 6643 | 6658 | ATGAGATACTCGACCA | 60 | 1983 |
| 1063626 | N/A | N/A | 7069 | 7084 | CTGCATAAGTCACAGA | 83 | 1984 |
| 1063658 | N/A | N/A | 7356 | 7371 | ATGCTATGATCATCCC | 26 | 1985 |
| 1063690 | N/A | N/A | 7568 | 7583 | ATTCACCGTCCATACC | 68 | 1986 |
| 1063722 | N/A | N/A | 7910 | 7925 | GAGACCTGACACCTTT | 57 | 1987 |
| 1063754 | N/A | N/A | 8034 | 8049 | GCCATTCGCAGGTGCT | 55 | 1988 |
| 1063785 | N/A | N/A | 8471 | 8486 | CTCACTTGAGGAAGTC | 101 | 1989 |
| 1063817 | N/A | N/A | 8705 | 8720 | AATAACAGCACAAACG | 71 | 1990 |
| 1063849 | N/A | N/A | 8901 | 8916 | AGGAGCTAGAACTTTG | 133 | 1991 |
| 1063881 | N/A | N/A | 9380 | 9395 | CCACGACAGGCCTGGT | 72 | 1992 |
| 1063913 | N/A | N/A | 9557 | 9572 | GTGGACAGAAGGTTTT | 44 | 1993 |
| 1063945 | N/A | N/A | 9870 | 9885 | TGAGGTTAGGTTCCCT | 73 | 1994 |
| 1063977 | N/A | N/A | 10381 | 10396 | GCAGGTTACATAGCTG | 57 | 1995 |
| 1064009 | N/A | N/A | 10662 | 10677 | CGTATGTGGCCACTGA | 56 | 1996 |
| 1064041 | N/A | N/A | 11313 | 11328 | GCAAGGACCATTCTTA | 86 | 1997 |
| 1064073 | N/A | N/A | 11476 | 11491 | CACGGACATCCCGAAA | 74 | 1998 |
| 1064107 | N/A | N/A | 11608 | 11623 | TTAGCAGGGTCCCTCC | 59 | 1999 |
| 1064139 | N/A | N/A | 11672 | 11687 | GCTCGGGCGAATCCAC | 117 | 2000 |
| 1064171 | N/A | N/A | 11792 | 11807 | GGAGTAACTTGCACAC | 89 | 2001 |
| 1064203 | N/A | N/A | 11883 | 11898 | GTACTGTTTGCTGAGC | 31 | 2002 |
| 1064235 | N/A | N/A | 11966 | 11981 | AGCTAGCTCCCTGTCC | 50 | 2003 |
| 1064267 | N/A | N/A | 12097 | 12112 | CCCTGCTTACCCAGCG | 71* | 2004 |
| 1064299 | N/A | N/A | 12358 | 12373 | GAGGTGGACATCTGGA | 52 | 2005 |
| 1064331 | N/A | N/A | 12483 | 12498 | TTGGGTTGGCATAAAG | 69 | 2006 |
| 1064363 | N/A | N/A | 12698 | 12713 | CTGGTATCATGTAGGG | 53 | 2007 |

TABLE 30-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064395 | N/A | N/A | 12869 | 12884 | AAGGATGAGGTTAGTT | 74 | 2008 |
| 1064427 | N/A | N/A | 13045 | 13060 | AGGCCAACTTAAGGGT | 74 | 2009 |
| 1064459 | N/A | N/A | 13337 | 13352 | ATCAGGGACAGGACTA | 177 | 2010 |

TABLE 31

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 34 | 65 |
| 911179 | N/A | N/A | 10316 | 10331 | GCTTTAACAACTCAGG | 16 | 306 |
| 1062027 | 70 | 85 | 470 | 485 | CCGAGAAGAAAAACCA | 69 | 2011 |
| 1062059 | 247 | 262 | 6785 | 6800 | CTGGGCGAGGCTCCTG | 129 | 2012 |
| 1062091 | 343 | 358 | 6881 | 6896 | GAGGCATGGGCCCCGC | 104 | 2013 |
| 1062123 | 502 | 517 | 7665 | 7680 | TCCACCGTTGAGAGCT | 85 | 2014 |
| 1062155 | 710 | 725 | 8287 | 8302 | CTTCCTGGGTGCACTG | 101 | 2015 |
| 1062187 | 833 | 848 | N/A | N/A | CGCCTGGCAGTGCTTG | 112 | 2016 |
| 1062219 | 1009 | 1024 | 11165 | 11180 | GAGCCCTTGTCGGATG | 129 | 2017 |
| 1062251 | 1164 | 1179 | 12034 | 12049 | AGTAGTCCATGTTGTG | 45* | 2018 |
| 1062283 | 1379 | 1394 | 13789 | 13804 | CTTCTCGCTCTCCACC | 104 | 2019 |
| 1062315 | 1523 | 1538 | 13933 | 13948 | GCCTCCCACCAGTTTG | 61 | 2020 |
| 1062347 | 1798 | 1813 | 14208 | 14223 | TAATCTGTGCGAGCAG | 37 | 2021 |
| 1062379 | 1920 | 1935 | 14330 | 14345 | TGATGCAGCTTTGAGG | 32 | 2022 |
| 1062411 | 2128 | 2143 | 14538 | 14553 | TGAGATACACAGGTGA | 63 | 2023 |
| 1062443 | 2319 | 2334 | N/A | N/A | GGCCTTGGATCCCAAA | 121 | 2024 |
| 1062475 | N/A | N/A | 13563 | 13578 | TCAGAGGAGCTCACCT | 138 | 2025 |
| 1062507 | N/A | N/A | 13659 | 13674 | ACATCCCGTTCCTCCC | 77 | 2026 |
| 1062539 | N/A | N/A | 671 | 686 | TCACGGTAGCTGGGTA | 79 | 2027 |
| 1062571 | N/A | N/A | 802 | 817 | ATCCTATCCATCTACG | 110 | 2028 |
| 1062603 | N/A | N/A | 1023 | 1038 | AGTGTAGCGACAGACA | 129 | 2029 |
| 1062635 | N/A | N/A | 1215 | 1230 | TTACTATTATTAAACG | 128 | 2030 |
| 1062667 | N/A | N/A | 1317 | 1332 | CAGTTAAGTGCTCAGC | 39 | 2031 |
| 1062700 | N/A | N/A | 1415 | 1430 | GGGTAGGTCCACACAG | 40 | 2032 |
| 1062732 | N/A | N/A | 1688 | 1703 | GATGTGAGGACAGTCT | 116 | 2033 |
| 1062764 | N/A | N/A | 1831 | 1846 | TTTAAAAATGCACGCC | 73 | 2034 |
| 1062796 | N/A | N/A | 2015 | 2030 | GGCCAATGAATAGTAA | 101 | 2035 |
| 1062828 | N/A | N/A | 2138 | 2153 | GGTTAATAACCATTCC | 90 | 2036 |
| 1062860 | N/A | N/A | 2348 | 2363 | AAGCCAACATAGGTGA | 64 | 2037 |

TABLE 31-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062892 | N/A | N/A | 2523 | 2538 | TATAACCATTGCAGTA | 58 | 2038 |
| 1062924 | N/A | N/A | 2678 | 2693 | CATCATCATATACCCT | 113 | 2039 |
| 1062956 | N/A | N/A | 2813 | 2828 | GGCATTTCAAACTGGA | 97 | 2040 |
| 1062988 | N/A | N/A | 3040 | 3055 | ACATTTGCTGGTCTCT | 45 | 2041 |
| 1063020 | N/A | N/A | 3189 | 3204 | CTGAGAGATAGGGATA | 79 | 2042 |
| 1063052 | N/A | N/A | 3342 | 3357 | CCTGAGATCTCTGGTC | 63 | 2043 |
| 1063084 | N/A | N/A | 3614 | 3629 | CCTGACCTATGGAGTC | 100 | 2044 |
| 1063116 | N/A | N/A | 3845 | 3860 | CGCCAGAGATGGCAAC | 103 | 2045 |
| 1063148 | N/A | N/A | 4039 | 4054 | TCTACGGTCCCAAAGT | 65 | 2046 |
| 1063180 | N/A | N/A | 4193 | 4208 | ACCCAGGTTTGAAGCT | 55 | 2047 |
| 1063212 | N/A | N/A | 4387 | 4402 | ACCACGGAGGAAGAGA | 94 | 2048 |
| 1063243 | N/A | N/A | 4467 | 4482 | CCTGTTGTCACAGCCC | 64 | 2049 |
| 1063275 | N/A | N/A | 4685 | 4700 | ATGTGGGATGGCCTGA | 123 | 2050 |
| 1063307 | N/A | N/A | 4813 | 4828 | CAAACTAATACCGATT | 96 | 2051 |
| 1063339 | N/A | N/A | 5171 | 5186 | TCCAGGTATTAAGTTC | 56 | 2052 |
| 1063371 | N/A | N/A | 5431 | 5446 | CCCATAGTGACTTGAG | 83 | 2053 |
| 1063403 | N/A | N/A | 5626 | 5641 | TATTGTCCTCACCTTG | 77 | 2054 |
| 1063435 | N/A | N/A | 5834 | 5849 | GATCATGCACGGATCC | 73 | 2055 |
| 1063467 | N/A | N/A | 5958 | 5973 | GTGCAAAAGTGCAGGT | 117 | 2056 |
| 1063499 | N/A | N/A | 6105 | 6120 | ATCTGAAGCTGGATCA | 99 | 2057 |
| 1063531 | N/A | N/A | 6257 | 6272 | AGTGACTAGGCATGGA | 47 | 2058 |
| 1063563 | N/A | N/A | 6408 | 6423 | TCCTCTATGAGGGCAA | 120 | 2059 |
| 1063595 | N/A | N/A | 6644 | 6659 | TATGAGATACTCGACC | 129 | 2060 |
| 1063627 | N/A | N/A | 7075 | 7090 | CAACATCTGCATAAGT | 93 | 2061 |
| 1063659 | N/A | N/A | 7357 | 7372 | GATGCTATGATCATCC | 114 | 2062 |
| 1063691 | N/A | N/A | 7570 | 7585 | CCATTCACCGTCCATA | 110 | 2063 |
| 1063723 | N/A | N/A | 7911 | 7926 | TGAGACCTGACACCTT | 78 | 2064 |
| 1063755 | N/A | N/A | 8035 | 8050 | GGCCATTCGCAGGTGC | 98 | 2065 |
| 1063786 | N/A | N/A | 8472 | 8487 | ACTCACTTGAGGAAGT | 152 | 2066 |
| 1063818 | N/A | N/A | 8760 | 8775 | GATCAAGACACTTAAC | 30 | 2067 |
| 1063850 | N/A | N/A | 8902 | 8917 | GAGGAGCTAGAACTTT | 88 | 2068 |
| 1063882 | N/A | N/A | 9381 | 9396 | ACCACGACAGGCCTGG | 87 | 2069 |
| 1063914 | N/A | N/A | 9560 | 9575 | ATGGTGGACAGAAGGT | 47 | 2070 |
| 1063946 | N/A | N/A | 9871 | 9886 | GTGAGGTTAGGTTCCC | 14 | 2071 |
| 1063978 | N/A | N/A | 10383 | 10398 | CTGCAGGTTACATAGC | 116 | 2072 |
| 1064010 | N/A | N/A | 10683 | 10698 | TTAGAGCACAGGTGCG | 115 | 2073 |
| 1064042 | N/A | N/A | 11314 | 11329 | TGCAAGGACCATTCTT | 110 | 2074 |
| 1064074 | N/A | N/A | 11478 | 11493 | GCCACGGACATCCCGA | 98 | 2075 |

TABLE 31-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064108 | N/A | N/A | 11609 | 11624 | CTTAGCAGGGTCCCTC | 45 | 2076 |
| 1064140 | N/A | N/A | 11673 | 11688 | AGCTCGGGCGAATCCA | 102 | 2077 |
| 1064172 | N/A | N/A | 11793 | 11808 | CGGAGTAACTTGCACA | 52 | 2078 |
| 1064204 | N/A | N/A | 11887 | 11902 | ACAGGTACTGTTTGCT | 50 | 2079 |
| 1064236 | N/A | N/A | 11967 | 11982 | TAGCTAGCTCCCTGTC | 100 | 2080 |
| 1064268 | N/A | N/A | 12153 | 12168 | TTGGGAGGCAGGTCCC | 85 | 2081 |
| 1064300 | N/A | N/A | 12359 | 12374 | TGAGGTGGACATCTGG | 47 | 2082 |
| 1064332 | N/A | N/A | 12484 | 12499 | GTTGGGTTGGCATAAA | 78 | 2083 |
| 1064364 | N/A | N/A | 12699 | 12714 | TCTGGTATCATGTAGG | 70 | 2084 |
| 1064396 | N/A | N/A | 12870 | 12885 | CAAGGATGAGGTTAGT | 148 | 2085 |
| 1064428 | N/A | N/A | 13113 | 13128 | GACATTTCAGGGTTGG | 71 | 2086 |
| 1064460 | N/A | N/A | 13338 | 13353 | AATCAGGGACAGGACT | 123 | 2087 |

TABLE 32

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 53 | 65 |
| 911179 | N/A | N/A | 10316 | 10331 | GCTTTAACAACTCAGG | 16 | 306 |
| 1062028 | 81 | 96 | 481 | 496 | TTGCTTTTATACCGAG | 8 | 2088 |
| 1062060 | 248 | 263 | 6786 | 6801 | GCTGGGCGAGGCTCCT | 53 | 2089 |
| 1062092 | 346 | 361 | 6884 | 6899 | GAGGAGGCATGGGCCC | 74 | 2090 |
| 1062124 | 503 | 518 | 7666 | 7681 | ATCCACCGTTGAGAGC | 118 | 2091 |
| 1062156 | 723 | 738 | N/A | N/A | AAAGGGTGCTGTCCTT | 77 | 2092 |
| 1062188 | 835 | 850 | N/A | N/A | TCCGCCTGGCAGTGCT | 83 | 2093 |
| 1062220 | 1012 | 1027 | 11168 | 11183 | CAGGAGCCCTTGTCGG | 109 | 2094 |
| 1062252 | 1165 | 1180 | 12035 | 12050 | AAGTAGTCCATGTTGT | 44* | 2095 |
| 1062284 | 1386 | 1401 | 13796 | 13811 | CAGCCCCCTTCTCGCT | 126 | 2096 |
| 1062316 | 1551 | 1566 | 13961 | 13976 | GCCTATCATCCCTGCC | 153 | 2097 |
| 1062348 | 1801 | 1816 | 14211 | 14226 | AAGTAATCTGTGCGAG | 36 | 2098 |
| 1062380 | 1921 | 1936 | 14331 | 14346 | ATGATGCAGCTTTGAG | 43 | 2099 |
| 1062412 | 2129 | 2144 | 14539 | 14554 | GTGAGATACACAGGTG | 45 | 2100 |
| 1062444 | 2337 | 2352 | N/A | N/A | ACGGTACTGTGGGTTG | 36 | 2101 |
| 1062476 | N/A | N/A | 13569 | 13584 | GCCACCTCAGAGGAGC | 141 | 2102 |
| 1062508 | N/A | N/A | 13665 | 13680 | CAACCCACATCCCGTT | 74 | 2103 |
| 1062540 | N/A | N/A | 672 | 687 | ATCACGGTAGCTGGGT | 95 | 2104 |
| 1062572 | N/A | N/A | 803 | 818 | AATCCTATCCATCTAC | 161 | 2105 |

TABLE 32-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062604 | N/A | N/A | 1033 | 1048 | AGAGAGTCTGAGTGTA | 121 | 2106 |
| 1062636 | N/A | N/A | 1220 | 1235 | CGACATTACTATTATT | 78 | 2107 |
| 1062668 | N/A | N/A | 1318 | 1333 | TCAGTTAAGTGCTCAG | 25 | 2108 |
| 1062701 | N/A | N/A | 1442 | 1457 | GACTCTGGTCACACAC | 88 | 2109 |
| 1062733 | N/A | N/A | 1701 | 1716 | CAAAGTTCATGCTGAT | 58 | 2110 |
| 1062765 | N/A | N/A | 1842 | 1857 | GGGTCATAAACTTTAA | 43 | 2111 |
| 1062797 | N/A | N/A | 2025 | 2040 | AAGCATGAATGGCCAA | 34 | 2112 |
| 1062829 | N/A | N/A | 2139 | 2154 | AGGTTAATAACCATTC | 40 | 2113 |
| 1062861 | N/A | N/A | 2350 | 2365 | AGAAGCCAACATAGGT | 28 | 2114 |
| 1062893 | N/A | N/A | 2524 | 2539 | TTATAACCATTGCAGT | 54 | 2115 |
| 1062925 | N/A | N/A | 2694 | 2709 | CAGTTTGAAATGTCAC | 128 | 2116 |
| 1062957 | N/A | N/A | 2815 | 2830 | GTGGCATTTCAAACTG | 116 | 2117 |
| 1062989 | N/A | N/A | 3041 | 3056 | AACATTTGCTGGTCTC | 23 | 2118 |
| 1063021 | N/A | N/A | 3193 | 3208 | CTGGCTGAGAGATAGG | 52 | 2119 |
| 1063053 | N/A | N/A | 3355 | 3370 | ATTTCGGTGAGGCCCT | 49 | 2120 |
| 1063085 | N/A | N/A | 3624 | 3639 | AACTAGGCCTCCTGAC | 64 | 2121 |
| 1063117 | N/A | N/A | 3847 | 3862 | TCCGCCAGAGATGGCA | 115 | 2122 |
| 1063149 | N/A | N/A | 4068 | 4083 | CTAGAATCTCAAAACC | 133 | 2123 |
| 1063181 | N/A | N/A | 4196 | 4211 | AGGACCCAGGTTTGAA | 105 | 2124 |
| 1063213 | N/A | N/A | 4388 | 4403 | CACCACGGAGGAAGAG | 139 | 2125 |
| 1063244 | N/A | N/A | 4469 | 4484 | GCCCTGTTGTCACAGC | 63 | 2126 |
| 1063276 | N/A | N/A | 4686 | 4701 | CATGTGGGATGGCCTG | 73 | 2127 |
| 1063308 | N/A | N/A | 4814 | 4829 | ACAAACTAATACCGAT | 106 | 2128 |
| 1063340 | N/A | N/A | 5174 | 5189 | GAATCCAGGTATTAAG | 72 | 2129 |
| 1063372 | N/A | N/A | 5432 | 5447 | TCCCATAGTGACTTGA | 53 | 2130 |
| 1063404 | N/A | N/A | 5627 | 5642 | CTATTGTCCTCACCTT | 42 | 2131 |
| 1063436 | N/A | N/A | 5837 | 5852 | TGTGATCATGCACGGA | 35 | 2132 |
| 1063468 | N/A | N/A | 5999 | 6014 | ACATTACCTGAGATGG | 130 | 2133 |
| 1063500 | N/A | N/A | 6107 | 6122 | TAATCTGAAGCTGGAT | 168 | 2134 |
| 1063532 | N/A | N/A | 6261 | 6276 | CCCCAGTGACTAGGCA | 78 | 2135 |
| 1063564 | N/A | N/A | 6413 | 6428 | ATGTGTCCTCTATGAG | 129 | 2136 |
| 1063596 | N/A | N/A | 6649 | 6664 | GGCGGTATGAGATACT | 97 | 2137 |
| 1063628 | N/A | N/A | 7081 | 7096 | GCCCTGCAACATCTGC | 70 | 2138 |
| 1063660 | N/A | N/A | 7360 | 7375 | GTAGATGCTATGATCA | 36 | 2139 |
| 1063692 | N/A | N/A | 7571 | 7586 | CCCATTCACCGTCCAT | 36 | 2140 |
| 1063724 | N/A | N/A | 7912 | 7927 | CTGAGACCTGACACCT | 71 | 2141 |
| 1063756 | N/A | N/A | 8036 | 8051 | CGGCCATTCGCAGGTG | 71 | 2142 |
| 1063787 | N/A | N/A | 8474 | 8489 | CCACTCACTTGAGGAA | 90 | 2143 |

TABLE 32-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063819 | N/A | N/A | 8765 | 8780 | ATTTTGATCAAGACAC | 52 | 2144 |
| 1063851 | N/A | N/A | 8904 | 8919 | TAGAGGAGCTAGAACT | 90 | 2145 |
| 1063883 | N/A | N/A | 9396 | 9411 | GATTCCATGCAGGTGA | 135 | 2146 |
| 1063915 | N/A | N/A | 9564 | 9579 | GCACATGGTGGACAGA | 20 | 2147 |
| 1063947 | N/A | N/A | 9872 | 9887 | TGTGAGGTTAGGTTCC | 10 | 2148 |
| 1063979 | N/A | N/A | 10411 | 10426 | CGCCATCTTGAAATCT | 45 | 2149 |
| 1064011 | N/A | N/A | 10684 | 10699 | ATTAGAGCACAGGTGC | 82 | 2150 |
| 1064043 | N/A | N/A | 11315 | 11330 | GTGCAAGGACCATTCT | 130 | 2151 |
| 1064075 | N/A | N/A | 11505 | 11520 | ACTCGAGACCATATGG | 111 | 2152 |
| 1064109 | N/A | N/A | 11610 | 11625 | ACTTAGCAGGGTCCCT | 108 | 2153 |
| 1064141 | N/A | N/A | 11674 | 11689 | GAGCTCGGGCGAATCC | 109 | 2154 |
| 1064173 | N/A | N/A | 11794 | 11809 | GCGGAGTAACTTGCAC | 49 | 2155 |
| 1064205 | N/A | N/A | 11888 | 11903 | CACAGGTACTGTTTGC | 51 | 2156 |
| 1064237 | N/A | N/A | 11968 | 11983 | CTAGCTAGCTCCCTGT | 134 | 2157 |
| 1064269 | N/A | N/A | 12190 | 12205 | GAACCCACTCTGAGGG | 134 | 2158 |
| 1064301 | N/A | N/A | 12360 | 12375 | CTGAGGTGGACATCTG | 47 | 2159 |
| 1064333 | N/A | N/A | 12529 | 12544 | TGTATTGACATACTGG | 133 | 2160 |
| 1064365 | N/A | N/A | 12704 | 12719 | GAATATCTGGTATCAT | 141 | 2161 |
| 1064397 | N/A | N/A | 12871 | 12886 | GCAAGGATGAGGTTAG | 107 | 2162 |
| 1064429 | N/A | N/A | 13152 | 13167 | GTCTGGGATGGAGTTG | 64 | 2163 |
| 1064461 | N/A | N/A | 13339 | 13354 | TAATCAGGGACAGGAC | 68 | 2164 |

TABLE 33

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 35 | 65 |
| 911179 | N/A | N/A | 10316 | 10331 | GCTTTAACAACTCAGG | 23 | 306 |
| 1062029 | 82 | 97 | 482 | 497 | TTTGCTTTTATACCGA | 7 | 2165 |
| 1062061 | 249 | 264 | 6787 | 6802 | AGCTGGGCGAGGCTCC | 185 | 2166 |
| 1062093 | 347 | 362 | 6885 | 6900 | AGAGGAGGCATGGGCC | 36 | 2167 |
| 1062125 | 505 | 520 | 7668 | 7683 | GCATCCACCGTTGAGA | 29 | 2168 |
| 1062157 | 724 | 739 | N/A | N/A | GAAAGGGTGCTGTCCT | 266 | 2169 |
| 1062189 | 842 | 857 | 9432 | 9447 | AAGATGGTCCGCCTGG | 76 | 2170 |
| 1062221 | 1014 | 1029 | 11170 | 11185 | AGCAGGAGCCCTTGTC | 188 | 2171 |
| 1062253 | 1166 | 1181 | 12036 | 12051 | GAAGTAGTCCATGTTG | 76* | 2172 |
| 1062285 | 1395 | 1410 | 13805 | 13820 | CGGTCCACACAGCCCC | 99 | 2173 |

TABLE 33-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062317 | 1553 | 1568 | 13963 | 13978 | GGGCCTATCATCCCTG | 103 | 2174 |
| 1062349 | 1803 | 1818 | 14213 | 14228 | TGAAGTAATCTGTGCG | 29 | 2175 |
| 1062381 | 1923 | 1938 | 14333 | 14348 | TGATGATGCAGCTTTG | 56 | 2176 |
| 1062413 | 2130 | 2145 | 14540 | 14555 | CGTGAGATACACAGGT | 11 | 2177 |
| 1062445 | 2338 | 2353 | N/A | N/A | GACGGTACTGTGGGTT | 94 | 2178 |
| 1062477 | N/A | N/A | 13572 | 13587 | ACCGCCACCTCAGAGG | 81 | 2179 |
| 1062509 | N/A | N/A | 13666 | 13681 | ACAACCCACATCCCGT | 43 | 2180 |
| 1062541 | N/A | N/A | 673 | 688 | AATCACGGTAGCTGGG | 72 | 2181 |
| 1062573 | N/A | N/A | 825 | 840 | CTGGCAGCTGACATAT | 148 | 2182 |
| 1062605 | N/A | N/A | 1034 | 1049 | AAGAGAGTCTGAGTGT | 43 | 2183 |
| 1062637 | N/A | N/A | 1223 | 1238 | CGGCGACATTACTATT | 87 | 2184 |
| 1062669 | N/A | N/A | 1319 | 1334 | TTCAGTTAAGTGCTCA | 9 | 2185 |
| 1062702 | N/A | N/A | 1445 | 1460 | ATGGACTCTGGTCACA | 74 | 2186 |
| 1062734 | N/A | N/A | 1702 | 1717 | TCAAAGTTCATGCTGA | 42 | 2187 |
| 1062766 | N/A | N/A | 1845 | 1860 | AGAGGGTCATAAACTT | 71 | 2188 |
| 1062798 | N/A | N/A | 2055 | 2070 | GACCAGACAACCAAAA | 212 | 2189 |
| 1062830 | N/A | N/A | 2143 | 2158 | TGAAAGGTTAATAACC | 36 | 2190 |
| 1062862 | N/A | N/A | 2351 | 2366 | TAGAAGCCAACATAGG | 34 | 2191 |
| 1062894 | N/A | N/A | 2525 | 2540 | ATTATAACCATTGCAG | 15 | 2192 |
| 1062926 | N/A | N/A | 2696 | 2711 | CCCAGTTTGAAATGTC | 110 | 2193 |
| 1062958 | N/A | N/A | 2826 | 2841 | TTGTGATGAATGTGGC | 159 | 2194 |
| 1062990 | N/A | N/A | 3042 | 3057 | GAACATTTGCTGGTCT | 62 | 2195 |
| 1063022 | N/A | N/A | 3196 | 3211 | GGACTGGCTGAGAGAT | 113 | 2196 |
| 1063054 | N/A | N/A | 3356 | 3371 | CATTTCGGTGAGGCCC | 18 | 2197 |
| 1063086 | N/A | N/A | 3625 | 3640 | CAACTAGGCCTCCTGA | 110 | 2198 |
| 1063118 | N/A | N/A | 3848 | 3863 | CTCCGCCAGAGATGGC | 153 | 2199 |
| 1063150 | N/A | N/A | 4072 | 4087 | GATCCTAGAATCTCAA | 38 | 2200 |
| 1063182 | N/A | N/A | 4197 | 4212 | GAGGACCCAGGTTTGA | 78 | 2201 |
| 1063214 | N/A | N/A | 4390 | 4405 | GACACCACGGAGGAAG | 45 | 2202 |
| 1063245 | N/A | N/A | 4473 | 4488 | CTGGGCCCTGTTGTCA | 78 | 2203 |
| 1063277 | N/A | N/A | 4689 | 4704 | ACACATGTGGGATGGC | 87 | 2204 |
| 1063309 | N/A | N/A | 4847 | 4862 | ACTCAGTTGTGGTACT | 143 | 2205 |
| 1063341 | N/A | N/A | 5176 | 5191 | GAGAATCCAGGTATTA | 93 | 2206 |
| 1063373 | N/A | N/A | 5433 | 5448 | GTCCCATAGTGACTTG | 145 | 2207 |
| 1063405 | N/A | N/A | 5628 | 5643 | TCTATTGTCCTCACCT | 114 | 2208 |
| 1063437 | N/A | N/A | 5838 | 5853 | GTGTGATCATGCACGG | 31 | 2209 |
| 1063469 | N/A | N/A | 6000 | 6015 | GACATTACCTGAGATG | 98 | 2210 |
| 1063501 | N/A | N/A | 6110 | 6125 | ACTTAATCTGAAGCTG | 61 | 2211 |

TABLE 33-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063533 | N/A | N/A | 6264 | 6279 | TTGCCCCAGTGACTAG | 104 | 2212 |
| 1063565 | N/A | N/A | 6424 | 6439 | CCCTGGTGTGGATGTG | 85 | 2213 |
| 1063597 | N/A | N/A | 6650 | 6665 | GGGCGGTATGAGATAC | 92 | 2214 |
| 1063629 | N/A | N/A | 7090 | 7105 | ATTTTCTTGGCCCTGC | 105 | 2215 |
| 1063661 | N/A | N/A | 7362 | 7377 | TGGTAGATGCTATGAT | 40 | 2216 |
| 1063693 | N/A | N/A | 7641 | 7656 | CATGTGGGCTGTGGTT | 40 | 2217 |
| 1063725 | N/A | N/A | 7916 | 7931 | GCCTCTGAGACCTGAC | 57 | 2218 |
| 1063757 | N/A | N/A | 8037 | 8052 | ACGGCCATTCGCAGGT | 24 | 2219 |
| 1063788 | N/A | N/A | 8475 | 8490 | GCCACTCACTTGAGGA | 150 | 2220 |
| 1063820 | N/A | N/A | 8766 | 8781 | GATTTGATCAAGACA | 118 | 2221 |
| 1063852 | N/A | N/A | 8905 | 8920 | CTAGAGGAGCTAGAAC | 72 | 2222 |
| 1063884 | N/A | N/A | 9397 | 9412 | AGATTCCATGCAGGTG | 128 | 2223 |
| 1063916 | N/A | N/A | 9578 | 9593 | GAACTTGGTTTCTGGC | 53 | 2224 |
| 1063948 | N/A | N/A | 9873 | 9888 | ATGTGAGGTTAGGTTC | 20 | 2225 |
| 1063980 | N/A | N/A | 10416 | 10431 | GTGGTCGCCATCTTGA | 12 | 2226 |
| 1064012 | N/A | N/A | 10685 | 10700 | TATTAGAGCACAGGTG | 31 | 2227 |
| 1064044 | N/A | N/A | 11316 | 11331 | AGTGCAAGGACCATTC | 79 | 2228 |
| 1064076 | N/A | N/A | 11506 | 11521 | CACTCGAGACCATATG | 104 | 2229 |
| 1064110 | N/A | N/A | 11612 | 11627 | TTACTTAGCAGGGTCC | 84 | 2230 |
| 1064142 | N/A | N/A | 11675 | 11690 | TGAGCTCGGGCGAATC | 107 | 2231 |
| 1064174 | N/A | N/A | 11795 | 11810 | AGCGGAGTAACTTGCA | 33 | 2232 |
| 1064206 | N/A | N/A | 11889 | 11904 | GCACAGGTACTGTTTG | 83 | 2233 |
| 1064238 | N/A | N/A | 11969 | 11984 | CCTAGCTAGCTCCCTG | 32 | 2234 |
| 1064270 | N/A | N/A | 12191 | 12206 | GGAACCCACTCTGAGG | 106 | 2235 |
| 1064302 | N/A | N/A | 12361 | 12376 | GCTGAGGTGGACATCT | 106 | 2236 |
| 1064334 | N/A | N/A | 12531 | 12546 | GGTGTATTGACATACT | 52 | 2237 |
| 1064366 | N/A | N/A | 12732 | 12747 | TCAGGGTTTCAGTTCA | 57 | 2238 |
| 1064398 | N/A | N/A | 12872 | 12887 | GGCAAGGATGAGGTTA | 120 | 2239 |
| 1064430 | N/A | N/A | 13158 | 13173 | TGAAAGGTCTGGGATG | 121 | 2240 |
| 1064462 | N/A | N/A | 13342 | 13357 | AGGTAATCAGGGACAG | 105 | 2241 |

TABLE 34

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 910950 | 1434 | 1449 | 13844 | 13859 | GCCTCTGGCTCCGTTT | 15 | 94 |
| 911144 | N/A | N/A | 7355 | 7370 | TGCTATGATCATCCCC | 23 | 65 |

TABLE 34-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062030 | 83 | 98 | 483 | 498 | CTTTGCTTTTATACCG | 3 | 2242 |
| 1062062 | 251 | 266 | 6789 | 6804 | CCAGCTGGGCGAGGCT | 107 | 2243 |
| 1062094 | 348 | 363 | 6886 | 6901 | AAGAGGAGGCATGGGC | 26 | 2244 |
| 1062126 | 556 | 571 | 7719 | 7734 | ATGGCTGGGCTCTCCA | 36 | 2245 |
| 1062158 | 728 | 743 | 8374 | 8389 | AGCCGAAAGGGTGCTG | 103 | 2246 |
| 1062190 | 843 | 858 | 9433 | 9448 | GAAGATGGTCCGCCTG | 59 | 2247 |
| 1062222 | 1015 | 1030 | 11171 | 11186 | CAGCAGGAGCCCTTGT | 104 | 2248 |
| 1062254 | 1167 | 1182 | 12037 | 12052 | TGAAGTAGTCCATGTT | 57* | 2249 |
| 1062286 | 1397 | 1412 | 13807 | 13822 | CACGGTCCACACAGCC | 76 | 2250 |
| 1062318 | 1554 | 1569 | 13964 | 13979 | AGGGCCTATCATCCCT | 74 | 2251 |
| 1062350 | 1804 | 1819 | 14214 | 14229 | CTGAAGTAATCTGTGC | 33 | 2252 |
| 1062382 | 1924 | 1939 | 14334 | 14349 | GTGATGATGCAGCTTT | 16 | 2253 |
| 1062414 | 2169 | 2184 | 14579 | 14594 | ACTCAAGAGACCCACT | 39 | 2254 |
| 1062446 | 2339 | 2354 | N/A | N/A | GGACGGTACTGTGGGT | 20 | 2255 |
| 1062478 | N/A | N/A | 13573 | 13588 | CACCGCCACCTCAGAG | 67 | 2256 |
| 1062510 | N/A | N/A | 13667 | 13682 | AACAACCCACATCCCG | 109 | 2257 |
| 1062542 | N/A | N/A | 674 | 689 | GAATCACGGTAGCTGG | 14 | 2258 |
| 1062574 | N/A | N/A | 828 | 843 | AGACTGGCAGCTGACA | 56 | 2259 |
| 1062606 | N/A | N/A | 1052 | 1067 | CCAGGAGAGATGCGGG | 85 | 2260 |
| 1062638 | N/A | N/A | 1224 | 1239 | TCGGCGACATTACTAT | 29 | 2261 |
| 1062670 | N/A | N/A | 1324 | 1339 | CAAAGTTCAGTTAAGT | 24 | 2262 |
| 1062703 | N/A | N/A | 1448 | 1463 | AATATGGACTCTGGTC | 50 | 2263 |
| 1062735 | N/A | N/A | 1703 | 1718 | ATCAAAGTTCATGCTG | 53 | 2264 |
| 1062767 | N/A | N/A | 1847 | 1862 | AGAGAGGGTCATAAAC | 45 | 2265 |
| 1062799 | N/A | N/A | 2065 | 2080 | GTAAGGACATGACCAG | 27 | 2266 |
| 1062831 | N/A | N/A | 2148 | 2163 | GCTGATGAAAGGTTAA | 31 | 2267 |
| 1062863 | N/A | N/A | 2352 | 2367 | CTAGAAGCCAACATAG | 75 | 2268 |
| 1062895 | N/A | N/A | 2526 | 2541 | TATTATAACCATTGCA | 32 | 2269 |
| 1062927 | N/A | N/A | 2716 | 2731 | ATCCCAACAACCCCTC | 50 | 2270 |
| 1062959 | N/A | N/A | 2846 | 2861 | ACATATGGAGAGAACT | 56 | 2271 |
| 1062991 | N/A | N/A | 3043 | 3058 | AGAACATTTGCTGGTC | 9 | 2272 |
| 1063023 | N/A | N/A | 3211 | 3226 | GCCCCTCTATCCAGGG | 76 | 2273 |
| 1063055 | N/A | N/A | 3359 | 3374 | CTGCATTTCGGTGAGG | 22 | 2274 |
| 1063087 | N/A | N/A | 3626 | 3641 | CCAACTAGGCCTCCTG | 81 | 2275 |
| 1063119 | N/A | N/A | 3850 | 3865 | CACTCCGCCAGAGATG | 31 | 2276 |
| 1063151 | N/A | N/A | 4073 | 4088 | GGATCCTAGAATCTCA | 60 | 2277 |
| 1063183 | N/A | N/A | 4198 | 4213 | AGAGGACCCAGGTTTG | 55 | 2278 |
| 1063215 | N/A | N/A | 4391 | 4406 | CGACACCACGGAGGAA | 68 | 2279 |

TABLE 34-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063246 | N/A | N/A | 4477 | 4492 | GCATCTGGGCCCTGTT | 57 | 2280 |
| 1063278 | N/A | N/A | 4692 | 4707 | CAAACACATGTGGGAT | 87 | 2281 |
| 1063310 | N/A | N/A | 4870 | 4885 | GATCAATTTCTGTTGC | 11 | 2282 |
| 1063342 | N/A | N/A | 5177 | 5192 | TGAGAATCCAGGTATT | 38 | 2283 |
| 1063374 | N/A | N/A | 5435 | 5450 | TAGTCCCATAGTGACT | 104 | 2284 |
| 1063406 | N/A | N/A | 5630 | 5645 | CTTCTATTGTCCTCAC | 31 | 2285 |
| 1063438 | N/A | N/A | 5839 | 5854 | AGTGTGATCATGCACG | 96 | 2286 |
| 1063470 | N/A | N/A | 6001 | 6016 | TGACATTACCTGAGAT | 30 | 2287 |
| 1063502 | N/A | N/A | 6112 | 6127 | AGACTTAATCTGAAGC | 29 | 2288 |
| 1063534 | N/A | N/A | 6267 | 6282 | ATTTTGCCCCAGTGAC | 66 | 2289 |
| 1063566 | N/A | N/A | 6425 | 6440 | GCCCTGGTGTGGATGT | 79 | 2290 |
| 1063598 | N/A | N/A | 6651 | 6666 | AGGGCGGTATGAGATA | 30 | 2291 |
| 1063630 | N/A | N/A | 7118 | 7133 | TCCAATCTCTGAGGCC | 45 | 2292 |
| 1063662 | N/A | N/A | 7363 | 7378 | ATGGTAGATGCTATGA | 57 | 2293 |
| 1063694 | N/A | N/A | 7662 | 7677 | ACCGTTGAGAGCTGGG | 35 | 2294 |
| 1063726 | N/A | N/A | 7928 | 7943 | TGGAGTTTCCAAGCCT | 67 | 2295 |
| 1063758 | N/A | N/A | 8038 | 8053 | GACGGCCATTCGCAGG | 54 | 2296 |
| 1063789 | N/A | N/A | 8497 | 8512 | CGGTAGACTGGCACAG | 58 | 2297 |
| 1063821 | N/A | N/A | 8773 | 8788 | ACTGGGAGATTTTGAT | 104 | 2298 |
| 1063853 | N/A | N/A | 8906 | 8921 | TCTAGAGGAGCTAGAA | 38 | 2299 |
| 1063885 | N/A | N/A | 9405 | 9420 | TAGGGAGAAGATTCCA | 83 | 2300 |
| 1063917 | N/A | N/A | 9582 | 9597 | AGGTGAACTTGGTTTC | 20 | 2301 |
| 1063949 | N/A | N/A | 9879 | 9894 | ACCTGAATGTGAGGTT | 42 | 2302 |
| 1063981 | N/A | N/A | 10418 | 10433 | CTGTGGTCGCCATCTT | 4 | 2303 |
| 1064013 | N/A | N/A | 10694 | 10709 | AGCCGTATTTATTAGA | 29 | 2304 |
| 1064045 | N/A | N/A | 11317 | 11332 | TAGTGCAAGGACCATT | 33 | 2305 |
| 1064077 | N/A | N/A | 11507 | 11522 | ACACTCGAGACCATAT | 93 | 2306 |
| 1064111 | N/A | N/A | 11613 | 11628 | ATTACTTAGCAGGGTC | 22 | 2307 |
| 1064143 | N/A | N/A | 11677 | 11692 | GGTGAGCTCGGGCGAA | 36 | 2308 |
| 1064175 | N/A | N/A | 11796 | 11811 | AAGCGGAGTAACTTGC | 50 | 2309 |
| 1064207 | N/A | N/A | 11891 | 11906 | GGGCACAGGTACTGTT | 60 | 2310 |
| 1064239 | N/A | N/A | 11970 | 11985 | TCCTAGCTAGCTCCCT | 35 | 2311 |
| 1064271 | N/A | N/A | 12192 | 12207 | AGGAACCCACTCTGAG | 49 | 2312 |
| 1064303 | N/A | N/A | 12362 | 12377 | GGCTGAGGTGGACATC | 23 | 2313 |
| 1064335 | N/A | N/A | 12553 | 12568 | TTGGGAATGGTGCCCA | 35 | 2314 |
| 1064367 | N/A | N/A | 12738 | 12753 | GCTAGGTCAGGGTTTC | 68 | 2315 |
| 1064399 | N/A | N/A | 12884 | 12899 | GGTTAGGCTCAGGGCA | 71 | 2316 |

TABLE 34-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064431 | N/A | N/A | 13159 | 13174 | GTGAAAGGTCTGGGAT | 89 | 2317 |
| 1064463 | N/A | N/A | 13344 | 13359 | GCAGGTAATCAGGGAC | 86 | 2318 |

TABLE 35

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 42 | 65 |
| 911179 | N/A | N/A | 10316 | 10331 | GCTTTAACAACTCAGG | 19 | 306 |
| 1062031 | 97 | 112 | 497 | 512 | CGTATCAAAAACAACT | 98 | 2319 |
| 1062063 | 268 | 283 | 6806 | 6821 | GCTTTGGGTGCAGCCC | 104 | 2320 |
| 1062095 | 375 | 390 | 6913 | 6928 | GCGATGGTGGCATGGG | 67 | 2321 |
| 1062127 | 559 | 574 | 7722 | 7737 | ATCATGGCTGGGCTCT | 57 | 2322 |
| 1062159 | 729 | 744 | 8375 | 8390 | CAGCCGAAAGGGTGCT | 136 | 2323 |
| 1062191 | 844 | 859 | 9434 | 9449 | AGAAGATGGTCCGCCT | 48 | 2324 |
| 1062223 | 1023 | 1038 | 11179 | 11194 | CTACGATGCAGCAGGA | 65 | 2325 |
| 1062255 | 1170 | 1185 | 12040 | 12055 | ACTTGAAGTAGTCCAT | 56* | 2326 |
| 1062287 | 1413 | 1428 | 13823 | 13838 | GGAACTCCAGCTCATC | 85 | 2327 |
| 1062319 | 1555 | 1570 | 13965 | 13980 | CAGGGCCTATCATCCC | 103 | 2328 |
| 1062351 | 1805 | 1820 | 14215 | 14230 | CCTGAAGTAATCTGTG | 102 | 2329 |
| 1062383 | 1925 | 1940 | 14335 | 14350 | TGTGATGATGCAGCTT | 14 | 2330 |
| 1062415 | 2173 | 2188 | 14583 | 14598 | CGGGACTCAAGAGACC | 93 | 2331 |
| 1062447 | 2357 | 2372 | N/A | N/A | TCGGCTGCAGTTTATT | 36 | 2332 |
| 1062479 | N/A | N/A | 13576 | 13591 | AGTCACCGCCACCTCA | 53 | 2333 |
| 1062511 | N/A | N/A | 13668 | 13683 | CAACAACCCACATCCC | 97 | 2334 |
| 1062543 | N/A | N/A | 675 | 690 | GGAATCACGGTAGCTG | 31 | 2335 |
| 1062575 | N/A | N/A | 829 | 844 | AAGACTGGCAGCTGAC | 56 | 2336 |
| 1062607 | N/A | N/A | 1053 | 1068 | GCCAGGAGAGATGCGG | 124 | 2337 |
| 1062639 | N/A | N/A | 1225 | 1240 | CTCGGCGACATTACTA | 41 | 2338 |
| 1062671 | N/A | N/A | 1325 | 1340 | GCAAAGTTCAGTTAAG | 53 | 2339 |
| 1062704 | N/A | N/A | 1449 | 1464 | GAATATGGACTCTGGT | 74 | 2340 |
| 1062736 | N/A | N/A | 1705 | 1720 | CAATCAAAGTTCATGC | 63 | 2341 |
| 1062768 | N/A | N/A | 1848 | 1863 | CAGAGAGGGTCATAAA | 72 | 2342 |
| 1062800 | N/A | N/A | 2066 | 2081 | AGTAAGGACATGACCA | 66 | 2343 |
| 1062832 | N/A | N/A | 2149 | 2164 | GGCTGATGAAAGGTTA | 11 | 2344 |
| 1062864 | N/A | N/A | 2353 | 2368 | ACTAGAAGCCAACATA | 110 | 2345 |

TABLE 35-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062896 | N/A | N/A | 2527 | 2542 | CTATTATAACCATTGC | 44 | 2346 |
| 1062928 | N/A | N/A | 2718 | 2733 | TTATCCCAACAACCCC | 58 | 2347 |
| 1062960 | N/A | N/A | 2847 | 2862 | CACATATGGAGAGAAC | 84 | 2348 |
| 1062992 | N/A | N/A | 3058 | 3073 | GGATTGCCTCAAATAA | 69 | 2349 |
| 1063024 | N/A | N/A | 3216 | 3231 | CAATTGCCCCTCTATC | 85 | 2350 |
| 1063056 | N/A | N/A | 3368 | 3383 | ACTCTGCCGCTGCATT | 69 | 2351 |
| 1063088 | N/A | N/A | 3627 | 3642 | GCCAACTAGGCCTCCT | 112 | 2352 |
| 1063120 | N/A | N/A | 3853 | 3868 | GGCCACTCCGCCAGAG | 127 | 2353 |
| 1063152 | N/A | N/A | 4075 | 4090 | AAGGATCCTAGAATCT | 70 | 2354 |
| 1063184 | N/A | N/A | 4199 | 4214 | GAGAGGACCCAGGTTT | 83 | 2355 |
| 1063216 | N/A | N/A | 4393 | 4408 | ATCGACACCACGGAGG | 74 | 2356 |
| 1063247 | N/A | N/A | 4497 | 4512 | ATGTTTTCATATCGGG | 39 | 2357 |
| 1063279 | N/A | N/A | 4693 | 4708 | CCAAACACATGTGGGA | 113 | 2358 |
| 1063311 | N/A | N/A | 4943 | 4958 | CCTTATGGCCCCCAGA | 99 | 2359 |
| 1063343 | N/A | N/A | 5178 | 5193 | GTGAGAATCCAGGTAT | 55 | 2360 |
| 1063375 | N/A | N/A | 5440 | 5455 | TTCCGTAGTCCCATAG | 103 | 2361 |
| 1063407 | N/A | N/A | 5633 | 5648 | GCTCTTCTATTGTCCT | 64 | 2362 |
| 1063439 | N/A | N/A | 5845 | 5860 | TCCAGGAGTGTGATCA | 106 | 2363 |
| 1063471 | N/A | N/A | 6003 | 6018 | GCTGACATTACCTGAG | 83 | 2364 |
| 1063503 | N/A | N/A | 6116 | 6131 | TCTGAGACTTAATCTG | 95 | 2365 |
| 1063535 | N/A | N/A | 6269 | 6284 | CTATTTTGCCCCAGTG | 92 | 2366 |
| 1063567 | N/A | N/A | 6426 | 6441 | AGCCCTGGTGTGGATG | 125 | 2367 |
| 1063599 | N/A | N/A | 6654 | 6669 | GCTAGGGCGGTATGAG | 127 | 2368 |
| 1063631 | N/A | N/A | 7119 | 7134 | CTCCAATCTCTGAGGC | 99 | 2369 |
| 1063663 | N/A | N/A | 7364 | 7379 | CATGGTAGATGCTATG | 110 | 2370 |
| 1063695 | N/A | N/A | 7793 | 7808 | TACCAGGTGGGAGGCC | 106 | 2371 |
| 1063727 | N/A | N/A | 7959 | 7974 | TAAGGTTCTGCACCTG | 123 | 2372 |
| 1063759 | N/A | N/A | 8039 | 8054 | AGACGGCCATTCGCAG | 70 | 2373 |
| 1063790 | N/A | N/A | 8499 | 8514 | GCCGGTAGACTGGCAC | 88 | 2374 |
| 1063822 | N/A | N/A | 8776 | 8791 | GGAACTGGGAGATTTT | 39 | 2375 |
| 1063854 | N/A | N/A | 8907 | 8922 | ATCTAGAGGAGCTAGA | 117 | 2376 |
| 1063886 | N/A | N/A | 9406 | 9421 | GTAGGGAGAAGATTCC | 120 | 2377 |
| 1063918 | N/A | N/A | 9584 | 9599 | CCAGGTGAACTTGGTT | 99 | 2378 |
| 1063950 | N/A | N/A | 9893 | 9908 | CCCTAGCTCTCAGGAC | 152 | 2379 |
| 1063982 | N/A | N/A | 10419 | 10434 | TCTGTGGTCGCCATCT | 31 | 2380 |
| 1064014 | N/A | N/A | 10698 | 10713 | CATGAGCCGTATTTAT | 56 | 2381 |

TABLE 35-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064046 | N/A | N/A | 11318 | 11333 | GTAGTGCAAGGACCAT | 73 | 2382 |
| 1064078 | N/A | N/A | 11509 | 11524 | CGACACTCGAGACCAT | 128 | 2383 |
| 1064112 | N/A | N/A | 11614 | 11629 | AATTACTTAGCAGGGT | 90 | 2384 |
| 1064144 | N/A | N/A | 11681 | 11696 | GATAGGTGAGCTCGGG | 52 | 2385 |
| 1064176 | N/A | N/A | 11797 | 11812 | GAAGCGGAGTAACTTG | 102 | 2386 |
| 1064208 | N/A | N/A | 11893 | 11908 | ACGGGCACAGGTACTG | 89 | 2387 |
| 1064240 | N/A | N/A | 11971 | 11986 | CTCCTAGCTAGCTCCC | 75 | 2388 |
| 1064272 | N/A | N/A | 12193 | 12208 | GAGGAACCCACTCTGA | 91 | 2389 |
| 1064304 | N/A | N/A | 12378 | 12393 | AGAGGGTTAGGTATGG | 97 | 2390 |
| 1064336 | N/A | N/A | 12559 | 12574 | GAAAGGTTGGGAATGG | 88 | 2391 |
| 1064368 | N/A | N/A | 12762 | 12777 | AGTGAGGCTATCAGTC | 84 | 2392 |
| 1064400 | N/A | N/A | 12891 | 12906 | GTTAGGTGGTTAGGCT | 64 | 2393 |
| 1064432 | N/A | N/A | 13160 | 13175 | GGTGAAAGGTCTGGGA | 79 | 2394 |
| 1064464 | N/A | N/A | 13375 | 13390 | AGCCATCTGACATGGG | 144 | 2395 |

TABLE 36

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 23 | 65 |
| 911179 | N/A | N/A | 10316 | 10331 | GCTTTAACAACTCAGG | 20 | 306 |
| 1062032 | 111 | 126 | 511 | 526 | GTGGGAAACTGTCACG | 51 | 2396 |
| 1062064 | 270 | 285 | 6808 | 6823 | AGGCTTTGGGTGCAGC | 247 | 2397 |
| 1062096 | 377 | 392 | 6915 | 6930 | CTGCGATGGTGGCATG | 236 | 2398 |
| 1062128 | 563 | 578 | 7726 | 7741 | GCTGATCATGGCTGGG | 94 | 2399 |
| 1062160 | 730 | 745 | 8376 | 8391 | ACAGCCGAAAGGGTGC | 306 | 2400 |
| 1062192 | 845 | 860 | 9435 | 9450 | CAGAAGATGGTCCGCC | 245 | 2401 |
| 1062224 | 1025 | 1040 | 11181 | 11196 | AGCTACGATGCAGCAG | 124 | 2402 |
| 1062256 | 1171 | 1186 | 12041 | 12056 | AACTTGAAGTAGTCCA | 44* | 2403 |
| 1062288 | 1414 | 1429 | 13824 | 13839 | CGGAACTCCAGCTCAT | 224 | 2404 |
| 1062320 | 1556 | 1571 | 13966 | 13981 | CCAGGGCCTATCATCC | 62 | 2405 |
| 1062352 | 1806 | 1821 | 14216 | 14231 | CCCTGAAGTAATCTGT | 75 | 2406 |
| 1062384 | 1926 | 1941 | 14336 | 14351 | GTGTGATGATGCAGCT | 38 | 2407 |
| 1062416 | 2174 | 2189 | 14584 | 14599 | ACGGGACTCAAGAGAC | 118 | 2408 |
| 1062448 | 2358 | 2373 | N/A | N/A | CTCGGCTGCAGTTTAT | 24 | 2409 |

TABLE 36-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062480 | N/A | N/A | 13579 | 13594 | CCCAGTCACCGCCACC | 51 | 2410 |
| 1062512 | N/A | N/A | 13669 | 13684 | CCAACAACCCACATCC | 249 | 2411 |
| 1062544 | N/A | N/A | 676 | 691 | TGGAATCACGGTAGCT | 72 | 2412 |
| 1062576 | N/A | N/A | 833 | 848 | CATAAAGACTGGCAGC | 77 | 2413 |
| 1062608 | N/A | N/A | 1054 | 1069 | GGCCAGGAGAGATGCG | 121 | 2414 |
| 1062640 | N/A | N/A | 1227 | 1242 | TCCTCGGCGACATTAC | 163 | 2415 |
| 1062672 | N/A | N/A | 1332 | 1347 | GATACAAGCAAAGTTC | 177 | 2416 |
| 1062705 | N/A | N/A | 1451 | 1466 | CTGAATATGGACTCTG | 88 | 2417 |
| 1062737 | N/A | N/A | 1706 | 1721 | TCAATCAAAGTTCATG | 24 | 2418 |
| 1062769 | N/A | N/A | 1849 | 1864 | GCAGAGAGGGTCATAA | 76 | 2419 |
| 1062801 | N/A | N/A | 2067 | 2082 | GAGTAAGGACATGACC | 110 | 2420 |
| 1062833 | N/A | N/A | 2151 | 2166 | ATGGCTGATGAAAGGT | 24 | 2421 |
| 1062865 | N/A | N/A | 2354 | 2369 | GACTAGAAGCCAACAT | 163 | 2422 |
| 1062897 | N/A | N/A | 2542 | 2557 | CTCCTGAGGAAGGTAC | 61 | 2423 |
| 1062929 | N/A | N/A | 2720 | 2735 | CATTATCCCAACAACC | 80 | 2424 |
| 1062961 | N/A | N/A | 2850 | 2865 | ACCCACATATGGAGAG | 218 | 2425 |
| 1062993 | N/A | N/A | 3060 | 3075 | GAGGATTGCCTCAAAT | 130 | 2426 |
| 1063025 | N/A | N/A | 3227 | 3242 | CTTCAAGTTGACAATT | 61 | 2427 |
| 1063057 | N/A | N/A | 3375 | 3390 | GATTTCAACTCTGCCG | 38 | 2428 |
| 1063089 | N/A | N/A | 3628 | 3643 | GGCCAACTAGGCCTCC | 202 | 2429 |
| 1063121 | N/A | N/A | 3855 | 3870 | ATGGCCACTCCGCCAG | 254 | 2430 |
| 1063153 | N/A | N/A | 4076 | 4091 | AAAGGATCCTAGAATC | 277 | 2431 |
| 1063185 | N/A | N/A | 4200 | 4215 | GGAGAGGACCCAGGTT | 53 | 2432 |
| 1063217 | N/A | N/A | 4394 | 4409 | CATCGACACCACGGAG | 73 | 2433 |
| 1063248 | N/A | N/A | 4498 | 4513 | TATGTTTTCATATCGG | 20 | 2434 |
| 1063280 | N/A | N/A | 4694 | 4709 | CCCAAACACATGTGGG | 206 | 2435 |
| 1063312 | N/A | N/A | 4944 | 4959 | CCCTTATGGCCCCAG | 57 | 2436 |
| 1063344 | N/A | N/A | 5180 | 5195 | GTGTGAGAATCCAGGT | 86 | 2437 |
| 1063376 | N/A | N/A | 5446 | 5461 | GCCGAGTTCCGTAGTC | 70 | 2438 |
| 1063408 | N/A | N/A | 5644 | 5659 | ACGCAAGACCTGCTCT | 198 | 2439 |
| 1063440 | N/A | N/A | 5846 | 5861 | GTCCAGGAGTGTGATC | 71 | 2440 |
| 1063472 | N/A | N/A | 6004 | 6019 | AGCTGACATTACCTGA | 63 | 2441 |
| 1063504 | N/A | N/A | 6119 | 6134 | GATTCTGAGACTTAAT | 62 | 2442 |
| 1063536 | N/A | N/A | 6270 | 6285 | CCTATTTTGCCCCAGT | 89 | 2443 |
| 1063568 | N/A | N/A | 6427 | 6442 | CAGCCCTGGTGTGGAT | 59 | 2444 |
| 1063600 | N/A | N/A | 6656 | 6671 | GTGCTAGGGCGGTATG | 76 | 2445 |

TABLE 36-continued

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063632 | N/A | N/A | 7121 | 7136 | GCCTCCAATCTCTGAG | 228 | 2446 |
| 1063664 | N/A | N/A | 7368 | 7383 | CCCACATGGTAGATGC | 222 | 2447 |
| 1063696 | N/A | N/A | 7795 | 7810 | GTTACCAGGTGGGAGG | 51 | 2448 |
| 1063728 | N/A | N/A | 7960 | 7975 | TTAAGGTTCTGCACCT | 92 | 2449 |
| 1063760 | N/A | N/A | 8040 | 8055 | AAGACGGCCATTCGCA | 61 | 2450 |
| 1063791 | N/A | N/A | 8501 | 8516 | GGGCCGGTAGACTGGC | 102 | 2451 |
| 1063823 | N/A | N/A | 8787 | 8802 | TCTGTCACTCAGGAAC | 104 | 2452 |
| 1063855 | N/A | N/A | 8908 | 8923 | CATCTAGAGGAGCTAG | 88 | 2453 |
| 1063887 | N/A | N/A | 9407 | 9422 | AGTAGGGAGAAGATTC | 82 | 2454 |
| 1063919 | N/A | N/A | 9585 | 9600 | CCCAGGTGAACTTGGT | 71 | 2455 |
| 1063951 | N/A | N/A | 9918 | 9933 | CATGTTTGGAGCTGGG | 76 | 2456 |
| 1063983 | N/A | N/A | 10448 | 10463 | TATGTGGCACCCTGTG | 100 | 2457 |
| 1064015 | N/A | N/A | 10706 | 10721 | CAAAACAGCATGAGCC | 93 | 2458 |
| 1064047 | N/A | N/A | 11342 | 11357 | GGATTAGGAGCTTGGG | 26 | 2459 |
| 1064079 | N/A | N/A | 11511 | 11526 | CCCGACACTCGAGACC | 50 | 2460 |
| 1064113 | N/A | N/A | 11616 | 11631 | GGAATTACTTAGCAGG | 30 | 2461 |
| 1064145 | N/A | N/A | 11682 | 11697 | GGATAGGTGAGCTCGG | 27 | 2462 |
| 1064177 | N/A | N/A | 11798 | 11813 | AGAAGCGGAGTAACTT | 94 | 2463 |
| 1064209 | N/A | N/A | 11894 | 11909 | CACGGGCACAGGTACT | 69 | 2464 |
| 1064241 | N/A | N/A | 11972 | 11987 | CCTCCTAGCTAGCTCC | 123 | 2465 |
| 1064273 | N/A | N/A | 12194 | 12209 | GGAGGAACCCACTCTG | 97 | 2466 |
| 1064305 | N/A | N/A | 12379 | 12394 | GAGAGGGTTAGGTATG | 162 | 2467 |
| 1064337 | N/A | N/A | 12565 | 12580 | TACAAGGAAAGGTTGG | 87 | 2468 |
| 1064369 | N/A | N/A | 12775 | 12790 | CGATGATGATTGCAGT | 70 | 2469 |
| 1064401 | N/A | N/A | 12892 | 12907 | GGTTAGGTGGTTAGGC | 75 | 2470 |
| 1064433 | N/A | N/A | 13162 | 13177 | GAGGTGAAAGGTCTGG | 36 | 2471 |
| 1064465 | N/A | N/A | 13379 | 13394 | CCCGAGCCATCTGACA | 88 | 2472 |

TABLE 37

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 35 | 65 |
| 911179 | N/A | N/A | 10316 | 10331 | GCTTTAACAACTCAGG | 15 | 306 |

TABLE 37-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062033 | 113 | 128 | 513 | 528 | TTGTGGGAAACTGTCA | 51 | 2473 |
| 1062065 | 280 | 295 | 6818 | 6833 | AGCAGGTCTGAGGCTT | 101 | 2474 |
| 1062097 | 378 | 393 | 6916 | 6931 | GCTGCGATGGTGGCAT | 81 | 2475 |
| 1062129 | 566 | 581 | 7729 | 7744 | GAGGCTGATCATGGCT | 47 | 2476 |
| 1062161 | 732 | 747 | 8378 | 8393 | GCACAGCCGAAAGGGT | 72 | 2477 |
| 1062193 | 846 | 861 | 9436 | 9451 | CCAGAAGATGGTCCGC | 71 | 2478 |
| 1062225 | 1026 | 1041 | 11182 | 11197 | CAGCTACGATGCAGCA | 108 | 2479 |
| 1062257 | 1172 | 1187 | 12042 | 12057 | GAACTTGAAGTAGTCC | 80* | 2480 |
| 1062289 | 1415 | 1430 | 13825 | 13840 | GCGGAACTCCAGCTCA | 95 | 2481 |
| 1062321 | 1558 | 1573 | 13968 | 13983 | ATCCAGGGCCTATCAT | 74 | 2482 |
| 1062353 | 1807 | 1822 | 14217 | 14232 | GCCCTGAAGTAATCTG | 65 | 2483 |
| 1062385 | 1927 | 1942 | 14337 | 14352 | TGTGTGATGATGCAGC | 32 | 2484 |
| 1062417 | 2175 | 2190 | 14585 | 14600 | CACGGGACTCAAGAGA | 54 | 2485 |
| 1062449 | 2361 | 2376 | N/A | N/A | GAGCTCGGCTGCAGTT | 88 | 2486 |
| 1062481 | N/A | N/A | 13580 | 13595 | TCCCAGTCACCGCCAC | 40 | 2487 |
| 1062513 | N/A | N/A | 13671 | 13686 | CACCAACAACCCACAT | 68 | 2488 |
| 1062545 | N/A | N/A | 677 | 692 | CTGGAATCACGGTAGC | 36 | 2489 |
| 1062577 | N/A | N/A | 836 | 851 | ATCCATAAAGACTGGC | 53 | 2490 |
| 1062609 | N/A | N/A | 1092 | 1107 | TCAAGATGGAGGAGAC | 109 | 2491 |
| 1062641 | N/A | N/A | 1233 | 1248 | TAAAGGTCCTCGGCGA | 30 | 2492 |
| 1062673 | N/A | N/A | 1333 | 1348 | CGATACAAGCAAAGTT | 79 | 2493 |
| 1062706 | N/A | N/A | 1452 | 1467 | CCTGAATATGGACTCT | 61 | 2494 |
| 1062738 | N/A | N/A | 1712 | 1727 | GTCAAATCAATCAAAG | 65 | 2495 |
| 1062770 | N/A | N/A | 1854 | 1869 | AATTAGCAGAGAGGGT | 75 | 2496 |
| 1062802 | N/A | N/A | 2069 | 2084 | AGGAGTAAGGACATGA | 18 | 2497 |
| 1062834 | N/A | N/A | 2154 | 2169 | GTAATGGCTGATGAAA | 39 | 2498 |
| 1062866 | N/A | N/A | 2355 | 2370 | AGACTAGAAGCCAACA | 83 | 2499 |
| 1062898 | N/A | N/A | 2543 | 2558 | ACTCCTGAGGAAGGTA | 76 | 2500 |
| 1062930 | N/A | N/A | 2721 | 2736 | CCATTATCCCAACAAC | 79 | 2501 |
| 1062962 | N/A | N/A | 2860 | 2875 | TTGGACATGGACCCAC | 89 | 2502 |
| 1062994 | N/A | N/A | 3061 | 3076 | GGAGGATTGCCTCAAA | 115 | 2503 |
| 1063026 | N/A | N/A | 3231 | 3246 | AGGGCTTCAAGTTGAC | 71 | 2504 |
| 1063058 | N/A | N/A | 3376 | 3391 | GGATTTCAACTCTGCC | 24 | 2505 |
| 1063090 | N/A | N/A | 3634 | 3649 | CGCTCTGGCCAACTAG | 59 | 2506 |
| 1063122 | N/A | N/A | 3859 | 3874 | ATACATGGCCACTCCG | 93 | 2507 |
| 1063154 | N/A | N/A | 4077 | 4092 | TAAGGATCCTAGAAT | 83 | 2508 |

TABLE 37-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063186 | N/A | N/A | 4210 | 4225 | CTTGGGTTGTGGAGAG | 58 | 2509 |
| 1063218 | N/A | N/A | 4395 | 4410 | TCATCGACACCACGGA | 77 | 2510 |
| 1063249 | N/A | N/A | 4499 | 4514 | TTATGTTTTCATATCG | 50 | 2511 |
| 1063281 | N/A | N/A | 4695 | 4710 | CCCCAAACACATGTGG | 135 | 2512 |
| 1063313 | N/A | N/A | 5000 | 5015 | TAACAAAGATTGCCAG | 75 | 2513 |
| 1063345 | N/A | N/A | 5185 | 5200 | GATGAGTGTGAGAATC | 81 | 2514 |
| 1063377 | N/A | N/A | 5448 | 5463 | ATGCCGAGTTCCGTAG | 46 | 2515 |
| 1063409 | N/A | N/A | 5645 | 5660 | CACGCAAGACCTGCTC | 81 | 2516 |
| 1063441 | N/A | N/A | 5850 | 5865 | GCGAGTCCAGGAGTGT | 46 | 2517 |
| 1063473 | N/A | N/A | 6008 | 6023 | ACCGAGCTGACATTAC | 79 | 2518 |
| 1063505 | N/A | N/A | 6122 | 6137 | GTAGATTCTGAGACTT | 74 | 2519 |
| 1063537 | N/A | N/A | 6272 | 6287 | GTCCTATTTTGCCCCA | 40 | 2520 |
| 1063569 | N/A | N/A | 6435 | 6450 | CGCTAGCACAGCCCTG | 102 | 2521 |
| 1063601 | N/A | N/A | 6673 | 6688 | GGAAAGGAGTCACACG | 117 | 2522 |
| 1063633 | N/A | N/A | 7126 | 7141 | GGAGAGCCTCCAATCT | 95 | 2523 |
| 1063665 | N/A | N/A | 7369 | 7384 | GCCCACATGGTAGATG | 76 | 2524 |
| 1063697 | N/A | N/A | 7796 | 7811 | TGTTACCAGGTGGGAG | 107 | 2525 |
| 1063729 | N/A | N/A | 7961 | 7976 | TTTAAGGTTCTGCACC | 106 | 2526 |
| 1063761 | N/A | N/A | 8041 | 8056 | AAAGACGGCCATTCGC | 51 | 2527 |
| 1063792 | N/A | N/A | 8511 | 8526 | CCACAAGCCAGGGCCG | 88 | 2528 |
| 1063824 | N/A | N/A | 8820 | 8835 | CTAGAGCCTGGCTACA | 70 | 2529 |
| 1063856 | N/A | N/A | 8909 | 8924 | CCATCTAGAGGAGCTA | 79 | 2530 |
| 1063888 | N/A | N/A | 9409 | 9424 | TAAGTAGGGAGAAGAT | 94 | 2531 |
| 1063920 | N/A | N/A | 9586 | 9601 | TCCCAGGTGAACTTGG | 88 | 2532 |
| 1063952 | N/A | N/A | 9922 | 9937 | TGGGCATGTTTGGAGC | 59 | 2533 |
| 1063984 | N/A | N/A | 10450 | 10465 | GTTATGTGGCACCCTG | 36 | 2534 |
| 1064016 | N/A | N/A | 10717 | 10732 | GTGGAATCCCACAAAA | 103 | 2535 |
| 1064048 | N/A | N/A | 11344 | 11359 | CAGGATTAGGAGCTTG | 80 | 2536 |
| 1064080 | N/A | N/A | 11512 | 11527 | GCCCGACACTCGAGAC | 64 | 2537 |
| 1064114 | N/A | N/A | 11618 | 11633 | CTGGAATTACTTAGCA | 57 | 2538 |
| 1064146 | N/A | N/A | 11685 | 11700 | AGTGGATAGGTGAGCT | 63 | 2539 |
| 1064178 | N/A | N/A | 11799 | 11814 | AAGAAGCGGAGTAACT | 99 | 2540 |
| 1064210 | N/A | N/A | 11895 | 11910 | CCACGGGCACAGGTAC | 96 | 2541 |
| 1064242 | N/A | N/A | 11973 | 11988 | ACCTCCTAGCTAGCTC | 93 | 2542 |
| 1064274 | N/A | N/A | 12195 | 12210 | TGGAGGAACCCACTCT | 87 | 2543 |
| 1064306 | N/A | N/A | 12380 | 12395 | GGAGAGGGTTAGGTAT | N.D. | 2544 |

TABLE 37-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064338 | N/A | N/A | 12566 | 12581 | TTACAAGGAAAGGTTG | 112 | 2545 |
| 1064370 | N/A | N/A | 12776 | 12791 | GCGATGATGATTGCAG | 109 | 2546 |
| 1064402 | N/A | N/A | 12920 | 12935 | TATCGAGTATCTTACG | 68 | 2547 |
| 1064434 | N/A | N/A | 13164 | 13179 | GTGAGGTGAAAGGTCT | 91 | 2548 |
| 1064466 | N/A | N/A | 13381 | 13396 | ACCCCGAGCCATCTGA | N.D. | 2549 |

TABLE 38

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 38 | 65 |
| 911179 | N/A | N/A | 10316 | 10331 | GCTTTAACAACTCAGG | 24 | 306 |
| 1062034 | 114 | 129 | 514 | 529 | CTTGTGGGAAACTGTC | 23 | 2550 |
| 1062066 | 289 | 304 | 6827 | 6842 | CGGGCCCCCAGCAGGT | 87 | 2551 |
| 1062098 | 379 | 394 | 6917 | 6932 | AGCTGCGATGGTGGCA | 89 | 2552 |
| 1062130 | 569 | 584 | 7732 | 7747 | TGTGAGGCTGATCATG | 65 | 2553 |
| 1062162 | 734 | 749 | 8380 | 8395 | GGGCACAGCCGAAAGG | 83 | 2554 |
| 1062194 | 847 | 862 | 9437 | 9452 | TCCAGAAGATGGTCCG | 73 | 2555 |
| 1062226 | 1027 | 1042 | 11183 | 11198 | GCAGCTACGATGCAGC | 116 | 2556 |
| 1062258 | 1173 | 1188 | 12043 | 12058 | GGAACTTGAAGTAGTC | 40* | 2557 |
| 1062290 | 1417 | 1432 | 13827 | 13842 | TTGCGGAACTCCAGCT | 112 | 2558 |
| 1062322 | 1569 | 1584 | 13979 | 13994 | CCTGTGGGCACATCCA | 33 | 2559 |
| 1062354 | 1808 | 1823 | 14218 | 14233 | AGCCCTGAAGTAATCT | 62 | 2560 |
| 1062386 | 1934 | 1949 | 14344 | 14359 | GTGTGATTGTGTGATG | 32 | 2561 |
| 1062418 | 2176 | 2191 | 14586 | 14601 | GCACGGGACTCAAGAG | 50 | 2562 |
| 1062450 | 2362 | 2377 | N/A | N/A | GGAGCTCGGCTGCAGT | 86 | 2563 |
| 1062482 | N/A | N/A | 13583 | 13598 | CCATCCCAGTCACCGC | 62 | 2564 |
| 1062514 | N/A | N/A | 13695 | 13710 | TCAACCTCTGAGGCCA | 78 | 2565 |
| 1062546 | N/A | N/A | 678 | 693 | GCTGGAATCACGGTAG | 41 | 2566 |
| 1062578 | N/A | N/A | 856 | 871 | AAGTTGTTCAAAGCTC | 40 | 2567 |
| 1062610 | N/A | N/A | 1093 | 1108 | GTCAAGATGGAGGAGA | 78 | 2568 |
| 1062642 | N/A | N/A | 1234 | 1249 | GTAAAGGTCCTCGGCG | 37 | 2569 |
| 1062674 | N/A | N/A | 1334 | 1349 | GCGATACAAGCAAAGT | 56 | 2570 |
| 1062707 | N/A | N/A | 1453 | 1468 | TCCTGAATATGGACTC | 55 | 2571 |
| 1062739 | N/A | N/A | 1713 | 1728 | GGTCAAATCAATCAAA | 31 | 2572 |

TABLE 38-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062771 | N/A | N/A | 1855 | 1870 | GAATTAGCAGAGAGGG | 30 | 2573 |
| 1062803 | N/A | N/A | 2070 | 2085 | TAGGAGTAAGGACATG | N.D. | 2574 |
| 1062835 | N/A | N/A | 2156 | 2171 | ATGTAATGGCTGATGA | 17 | 2575 |
| 1062867 | N/A | N/A | 2356 | 2371 | GAGACTAGAAGCCAAC | 80 | 2576 |
| 1062899 | N/A | N/A | 2544 | 2559 | GACTCCTGAGGAAGGT | 63 | 2577 |
| 1062931 | N/A | N/A | 2723 | 2738 | GTCCATTATCCCAACA | 45 | 2578 |
| 1062963 | N/A | N/A | 2861 | 2876 | CTTGGACATGGACCCA | 87 | 2579 |
| 1062995 | N/A | N/A | 3063 | 3078 | GAGGAGGATTGCCTCA | 99 | 2580 |
| 1063027 | N/A | N/A | 3232 | 3247 | CAGGGCTTCAAGTTGA | 67 | 2581 |
| 1063059 | N/A | N/A | 3386 | 3401 | ATCTAGGCTTGGATTT | 97 | 2582 |
| 1063091 | N/A | N/A | 3636 | 3651 | CACGCTCTGGCCAACT | 67 | 2583 |
| 1063123 | N/A | N/A | 3860 | 3875 | AATACATGGCCACTCC | 86 | 2584 |
| 1063155 | N/A | N/A | 4080 | 4095 | ATTTAAAGGATCCTAG | 118 | 2585 |
| 1063187 | N/A | N/A | 4213 | 4228 | CTTCTTGGGTTGTGGA | 37 | 2586 |
| 1063219 | N/A | N/A | 4396 | 4411 | TTCATCGACACCACGG | 34 | 2587 |
| 1063250 | N/A | N/A | 4535 | 4550 | TCAGAAGCTGAATGGG | 36 | 2588 |
| 1063282 | N/A | N/A | 4707 | 4722 | GCTAAGAATTCTCCCC | 57 | 2589 |
| 1063314 | N/A | N/A | 5072 | 5087 | GCACTGGTGAGATGAG | N.D. | 2590 |
| 1063346 | N/A | N/A | 5192 | 5207 | TGAGGGAGATGAGTGT | 73 | 2591 |
| 1063378 | N/A | N/A | 5453 | 5468 | CTCAGATGCCGAGTTC | 51 | 2592 |
| 1063410 | N/A | N/A | 5646 | 5661 | CCACGCAAGACCTGCT | N.D. | 2593 |
| 1063442 | N/A | N/A | 5852 | 5867 | AGGCGAGTCCAGGAGT | 80 | 2594 |
| 1063474 | N/A | N/A | 6009 | 6024 | GACCGAGCTGACATTA | 76 | 2595 |
| 1063506 | N/A | N/A | 6123 | 6138 | GGTAGATTCTGAGACT | 54 | 2596 |
| 1063538 | N/A | N/A | 6273 | 6288 | AGTCCTATTTTGCCCC | 29 | 2597 |
| 1063570 | N/A | N/A | 6437 | 6452 | CACGCTAGCACAGCCC | 97 | 2598 |
| 1063602 | N/A | N/A | 6674 | 6689 | GGGAAAGGAGTCACAC | 84 | 2599 |
| 1063634 | N/A | N/A | 7151 | 7166 | CCTGAGACAGGGATTG | 55 | 2600 |
| 1063666 | N/A | N/A | 7371 | 7386 | AAGCCCACATGGTAGA | 65 | 2601 |
| 1063698 | N/A | N/A | 7798 | 7813 | GGTGTTACCAGGTGGG | 35 | 2602 |
| 1063730 | N/A | N/A | 7962 | 7977 | CTTTAAGGTTCTGCAC | 110 | 2603 |
| 1063762 | N/A | N/A | 8042 | 8057 | TAAAGACGGCCATTCG | 53 | 2604 |
| 1063793 | N/A | N/A | 8526 | 8541 | ACCCTAGACCTCTCCC | 44 | 2605 |
| 1063825 | N/A | N/A | 8823 | 8838 | ATTCTAGAGCCTGGCT | 92 | 2606 |
| 1063857 | N/A | N/A | 8910 | 8925 | GCCATCTAGAGGAGCT | 109 | 2607 |
| 1063889 | N/A | N/A | 9410 | 9425 | CTAAGTAGGGAGAAGA | 117 | 2608 |

TABLE 38-continued

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063921 | N/A | N/A | 9605 | 9620 | TCCTTTATACCAGCCC | 25 | 2609 |
| 1063953 | N/A | N/A | 9923 | 9938 | CTGGGCATGTTTGGAG | 60 | 2610 |
| 1063985 | N/A | N/A | 10452 | 10467 | TGGTTATGTGGCACCC | 39 | 2611 |
| 1064017 | N/A | N/A | 10723 | 10738 | TCTGAGGTGGAATCCC | 21 | 2612 |
| 1064049 | N/A | N/A | 11345 | 11360 | TCAGGATTAGGAGCTT | 47 | 2613 |
| 1064081 | N/A | N/A | 11535 | 11550 | CCCCAAGGGAGTCAGG | 73 | 2614 |
| 1064115 | N/A | N/A | 11619 | 11634 | CCTGGAATTACTTAGC | 57 | 2615 |
| 1064147 | N/A | N/A | 11686 | 11701 | CAGTGGATAGGTGAGC | 25 | 2616 |
| 1064179 | N/A | N/A | 11800 | 11815 | AAAGAAGCGGAGTAAC | 88 | 2617 |
| 1064211 | N/A | N/A | 11896 | 11911 | TCCACGGGCACAGGTA | 86 | 2618 |
| 1064243 | N/A | N/A | 11975 | 11990 | GGACCTCCTAGCTAGC | 54 | 2619 |
| 1064275 | N/A | N/A | 12196 | 12211 | ATGGAGGAACCCACTC | 87 | 2620 |
| 1064307 | N/A | N/A | 12381 | 12396 | AGGAGAGGGTTAGGTA | 68 | 2621 |
| 1064339 | N/A | N/A | 12569 | 12584 | GTGTTACAAGGAAAGG | 68 | 2622 |
| 1064371 | N/A | N/A | 12778 | 12793 | CAGCGATGATGATTGC | 60 | 2623 |
| 1064403 | N/A | N/A | 12921 | 12936 | TTATCGAGTATCTTAC | 101 | 2624 |
| 1064435 | N/A | N/A | 13165 | 13180 | AGTGAGGTGAAAGGTC | 72 | 2625 |
| 1064467 | N/A | N/A | 13384 | 13399 | CCTACCCCGAGCCATC | 69 | 2626 |

TABLE 39

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 23 | 65 |
| 911179 | N/A | N/A | 10316 | 10331 | GCTTTAACAACTCAGG | 17 | 306 |
| 1062035 | 115 | 130 | 515 | 530 | GCTTGTGGGAAACTGT | 29 | 2627 |
| 1062067 | 302 | 317 | 6840 | 6855 | TCCCCCTGGGCCCCGG | 1 | 2628 |
| 1062099 | 412 | 427 | 7477 | 7492 | GCCACCATGACTAGGG | 154 | 2629 |
| 1062131 | 582 | 597 | 7745 | 7760 | CGGTGGTGGGTGGTGT | 106 | 2630 |
| 1062163 | 750 | 765 | 8396 | 8411 | GTGGGTAGGAGCTCTG | 58 | 2631 |
| 1062195 | 848 | 863 | 9438 | 9453 | ATCCAGAAGATGGTCC | 81 | 2632 |
| 1062227 | 1029 | 1044 | 11185 | 11200 | CAGCAGCTACGATGCA | 178 | 2633 |
| 1062259 | 1175 | 1190 | 12045 | 12060 | GTGGAACTTGAAGTAG | 8* | 2634 |
| 1062291 | 1418 | 1433 | 13828 | 13843 | CTTGCGGAACTCCAGC | 265 | 2635 |

TABLE 39-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1062323 | 1570 | 1585 | 13980 | 13995 | CCCTGTGGGCACATCC | 66 | 2636 |
| 1062355 | 1809 | 1824 | 14219 | 14234 | CAGCCCTGAAGTAATC | 190 | 2637 |
| 1062387 | 2019 | 2034 | 14429 | 14444 | CCTGTGTTGACAGTGC | 90 | 2638 |
| 1062419 | 2177 | 2192 | 14587 | 14602 | TGCACGGGACTCAAGA | 104 | 2639 |
| 1062483 | N/A | N/A | 13592 | 13607 | CACTTGAGGCCATCCC | 123 | 2640 |
| 1062515 | N/A | N/A | 13696 | 13711 | GTCAACCTCTGAGGCC | 123 | 2641 |
| 1062547 | N/A | N/A | 680 | 695 | TGGCTGGAATCACGGT | 134 | 2642 |
| 1062579 | N/A | N/A | 857 | 872 | CAAGTTGTTCAAAGCT | 91 | 2643 |
| 1062611 | N/A | N/A | 1094 | 1109 | GGTCAAGATGGAGGAG | 77 | 2644 |
| 1062643 | N/A | N/A | 1235 | 1250 | TGTAAAGGTCCTCGGC | 53 | 2645 |
| 1062676 | N/A | N/A | 1335 | 1350 | AGCGATACAAGCAAAG | 51 | 2646 |
| 1062708 | N/A | N/A | 1469 | 1484 | GAACAACCTGTTTGCT | 65 | 2647 |
| 1062740 | N/A | N/A | 1718 | 1733 | CACTTGGTCAAATCAA | 72 | 2648 |
| 1062772 | N/A | N/A | 1857 | 1872 | GAGAATTAGCAGAGAG | 37 | 2649 |
| 1062804 | N/A | N/A | 2072 | 2087 | ATTAGGAGTAAGGACA | 86 | 2650 |
| 1062836 | N/A | N/A | 2157 | 2172 | TATGTAATGGCTGATG | 53 | 2651 |
| 1062868 | N/A | N/A | 2364 | 2379 | CCATAAAAGAGACTAG | 93 | 2652 |
| 1062900 | N/A | N/A | 2548 | 2563 | CAAAGACTCCTGAGGA | 124 | 2653 |
| 1062932 | N/A | N/A | 2724 | 2739 | AGTCCATTATCCCAAC | 80 | 2654 |
| 1062964 | N/A | N/A | 2863 | 2878 | AGCTTGGACATGGACC | 162 | 2655 |
| 1062996 | N/A | N/A | 3064 | 3079 | AGAGGAGGATTGCCTC | 90 | 2656 |
| 1063028 | N/A | N/A | 3234 | 3249 | TGCAGGGCTTCAAGTT | 52 | 2657 |
| 1063060 | N/A | N/A | 3387 | 3402 | GATCTAGGCTTGGATT | 174 | 2658 |
| 1063092 | N/A | N/A | 3637 | 3652 | CCACGCTCTGGCCAAC | 113 | 2659 |
| 1063124 | N/A | N/A | 3861 | 3876 | AAATACATGGCCACTC | 93 | 2660 |
| 1063156 | N/A | N/A | 4081 | 4096 | GATTTAAAGGATCCTA | 70 | 2661 |
| 1063188 | N/A | N/A | 4215 | 4230 | CCCTTCTTGGGTTGTG | 77 | 2662 |
| 1063220 | N/A | N/A | 4397 | 4412 | CTTCATCGACACCACG | 92 | 2663 |
| 1063251 | N/A | N/A | 4548 | 4563 | CTGACTGGGTTTCTCA | 35 | 2664 |
| 1063283 | N/A | N/A | 4708 | 4723 | AGCTAAGAATTCTCCC | 67 | 2665 |
| 1063315 | N/A | N/A | 5073 | 5088 | AGCACTGGTGAGATGA | 43 | 2666 |
| 1063347 | N/A | N/A | 5255 | 5270 | GAGCAGTTGCTCCTTC | 174 | 2667 |
| 1063379 | N/A | N/A | 5454 | 5469 | GCTCAGATGCCGAGTT | 112 | 2668 |
| 1063411 | N/A | N/A | 5648 | 5663 | AGCCACGCAAGACCTG | 106 | 2669 |
| 1063443 | N/A | N/A | 5853 | 5868 | GAGGCGAGTCCAGGAG | 36 | 2670 |
| 1063475 | N/A | N/A | 6010 | 6025 | GGACCGAGCTGACATT | 68 | 2671 |

TABLE 39-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063507 | N/A | N/A | 6127 | 6142 | AGTGGGTAGATTCTGA | 44 | 2672 |
| 1063539 | N/A | N/A | 6274 | 6289 | GAGTCCTATTTTGCCC | 68 | 2673 |
| 1063571 | N/A | N/A | 6438 | 6453 | CCACGCTAGCACAGCC | 222 | 2674 |
| 1063603 | N/A | N/A | 6964 | 6979 | GGTACCCCACCCTGCC | 86 | 2675 |
| 1063635 | N/A | N/A | 7169 | 7184 | AATACGGCCTCCTCCT | 217 | 2676 |
| 1063667 | N/A | N/A | 7372 | 7387 | CAAGCCCACATGGTAG | 61 | 2677 |
| 1063699 | N/A | N/A | 7799 | 7814 | AGGTGTTACCAGGTGG | 23 | 2678 |
| 1063731 | N/A | N/A | 7966 | 7981 | GCATCTTTAAGGTTCT | 6 | 2679 |
| 1063763 | N/A | N/A | 8043 | 8058 | TTAAAGACGGCCATTC | 266 | 2680 |
| 1063794 | N/A | N/A | 8557 | 8572 | TTATTGGGATGAAGCC | 21 | 2681 |
| 1063826 | N/A | N/A | 8842 | 8857 | GGGCAAAGCAGGAGTG | 126 | 2682 |
| 1063858 | N/A | N/A | 8911 | 8926 | AGCCATCTAGAGGAGC | 101 | 2683 |
| 1063890 | N/A | N/A | 9411 | 9426 | CCTAAGTAGGGAGAAG | 421 | 2684 |
| 1063922 | N/A | N/A | 9633 | 9648 | TTCCCTGGGAGTGCCC | 37 | 2685 |
| 1063954 | N/A | N/A | 9927 | 9942 | AGGTCTGGGCATGTTT | 27 | 2686 |
| 1063986 | N/A | N/A | 10453 | 10468 | GTGGTTATGTGGCACC | 61 | 2687 |
| 1064018 | N/A | N/A | 10742 | 10757 | GCCCTCTTCTAAATTC | 40 | 2688 |
| 1064050 | N/A | N/A | 11347 | 11362 | TGTCAGGATTAGGAGC | 67 | 2689 |
| 1064082 | N/A | N/A | 11541 | 11556 | CCCAATCCCCAAGGGA | 118 | 2690 |
| 1064116 | N/A | N/A | 11620 | 11635 | TCCTGGAATTACTTAG | 212 | 2691 |
| 1064148 | N/A | N/A | 11687 | 11702 | GCAGTGGATAGGTGAG | 20 | 2692 |
| 1064180 | N/A | N/A | 11801 | 11816 | AAAAGAAGCGGAGTAA | 270 | 2693 |
| 1064212 | N/A | N/A | 11897 | 11912 | GTCCACGGGCACAGGT | 124 | 2694 |
| 1064244 | N/A | N/A | 11976 | 11991 | AGGACCTCCTAGCTAG | 169 | 2695 |
| 1064276 | N/A | N/A | 12197 | 12212 | AATGGAGGAACCCACT | 118 | 2696 |
| 1064308 | N/A | N/A | 12382 | 12397 | CAGGAGAGGGTTAGGT | 79 | 2697 |
| 1064340 | N/A | N/A | 12576 | 12591 | CAAATGGGTGTTACAA | 234 | 2698 |
| 1064372 | N/A | N/A | 12779 | 12794 | TCAGCGATGATGATTG | 84 | 2699 |
| 1064404 | N/A | N/A | 12922 | 12937 | ATTATCGAGTATCTTA | 74 | 2700 |
| 1064436 | N/A | N/A | 13176 | 13191 | GCTAGGGCTGAAGTGA | 101 | 2701 |
| 1064468 | N/A | N/A | 13389 | 13404 | TATGACCTACCCCGAG | 131 | 2702 |

TABLE 40

Inhibition of Foxp3 mRNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 30 | 65 |
| 911179 | N/A | N/A | 10316 | 10331 | GCTTTAACAACTCAGG | 21 | 306 |
| 1062036 | 117 | 132 | 517 | 532 | TGGCTTGTGGGAAACT | 36 | 2703 |
| 1062068 | 309 | 324 | 6847 | 6862 | GGAAGGTTCCCCCTGG | 44 | 2704 |
| 1062100 | 420 | 435 | 7485 | 7500 | CGGAGGGTGCCACCAT | 14 | 2705 |
| 1062132 | 591 | 606 | 7754 | 7769 | CCCCAGTGGCGGTGGT | 47 | 2706 |
| 1062164 | 751 | 766 | 8397 | 8412 | AGTGGGTAGGAGCTCT | 81 | 2707 |
| 1062196 | 857 | 872 | 9447 | 9462 | GCCCTTCTCATCCAGA | 52 | 2708 |
| 1062228 | 1047 | 1062 | 11203 | 11218 | CGACAGGGCCTTGGCT | 280 | 2709 |
| 1062260 | 1176 | 1191 | 12046 | 12061 | TGTGGAACTTGAAGTA | 33* | 2710 |
| 1062292 | 1421 | 1436 | 13831 | 13846 | TTTCTTGCGGAACTCC | 141 | 2711 |
| 1062324 | 1584 | 1599 | 13994 | 14009 | CCTCACTTCTTGGTCC | 51 | 2712 |
| 1062356 | 1847 | 1862 | 14257 | 14272 | ACAGGATTGTGACATT | 83 | 2713 |
| 1062388 | 2025 | 2040 | 14435 | 14450 | CACACCCCTGTGTTGA | 81 | 2714 |
| 1062420 | 2178 | 2193 | 14588 | 14603 | CTGCACGGGACTCAAG | 67 | 2715 |
| 1062484 | N/A | N/A | 13593 | 13608 | GCACTTGAGGCCATCC | 106 | 2716 |
| 1062516 | N/A | N/A | 13730 | 13745 | TCTGTGGAAGGCCGGG | 95 | 2717 |
| 1062548 | N/A | N/A | 681 | 696 | CTGGCTGGAATCACGG | 141 | 2718 |
| 1062580 | N/A | N/A | 863 | 878 | GCATTTCAAGTTGTTC | 5 | 2719 |
| 1062612 | N/A | N/A | 1107 | 1122 | ATCGATGGAGTGTGGT | 63 | 2720 |
| 1062644 | N/A | N/A | 1236 | 1251 | ATGTAAAGGTCCTCGG | 23 | 2721 |
| 1062677 | N/A | N/A | 1336 | 1351 | AAGCGATACAAGCAAA | 58 | 2722 |
| 1062709 | N/A | N/A | 1471 | 1486 | CTGAACAACCTGTTTG | 95 | 2723 |
| 1062741 | N/A | N/A | 1719 | 1734 | GCACTTGGTCAAATCA | 24 | 2724 |
| 1062773 | N/A | N/A | 1874 | 1889 | GGACAACCTTTTGGAA | 105 | 2725 |
| 1062805 | N/A | N/A | 2073 | 2088 | TATTAGGAGTAAGGAC | 70 | 2726 |
| 1062837 | N/A | N/A | 2158 | 2173 | ATATGTAATGGCTGAT | 18 | 2727 |
| 1062869 | N/A | N/A | 2365 | 2380 | GCCATAAAAGAGACTA | 58 | 2728 |
| 1062901 | N/A | N/A | 2554 | 2569 | TCTAAACAAAGACTCC | 81 | 2729 |
| 1062933 | N/A | N/A | 2729 | 2744 | TAGTCAGTCCATTATC | 42 | 2730 |
| 1062965 | N/A | N/A | 2864 | 2879 | AAGCTTGGACATGGAC | 70 | 2731 |
| 1062997 | N/A | N/A | 3066 | 3081 | CGAGAGGAGGATTGCC | 94 | 2732 |
| 1063029 | N/A | N/A | 3235 | 3250 | CTGCAGGGCTTCAAGT | 77 | 2733 |
| 1063061 | N/A | N/A | 3388 | 3403 | AGATCTAGGCTTGGAT | 142 | 2734 |
| 1063093 | N/A | N/A | 3639 | 3654 | CACCACGCTCTGGCCA | 96 | 2735 |
| 1063125 | N/A | N/A | 3862 | 3877 | CAAATACATGGCCACT | 87 | 2736 |

TABLE 40-continued

Inhibition of Foxp3 mRNA by 3-10-3 cEt gapmers targeting SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1063157 | N/A | N/A | 4084 | 4099 | TTAGATTTAAAGGATC | 78 | 2737 |
| 1063189 | N/A | N/A | 4218 | 4233 | TGGCCCTTCTTGGGTT | 99 | 2738 |
| 1063221 | N/A | N/A | 4401 | 4416 | CGGGCTTCATCGACAC | 36 | 2739 |
| 1063252 | N/A | N/A | 4553 | 4568 | CCTTTCTGACTGGGTT | 77 | 2740 |
| 1063284 | N/A | N/A | 4709 | 4724 | GAGCTAAGAATTCTCC | 97 | 2741 |
| 1063316 | N/A | N/A | 5074 | 5089 | GAGCACTGGTGAGATG | 43 | 2742 |
| 1063348 | N/A | N/A | 5273 | 5288 | TATAGAAGGGTTCTGG | 32 | 2743 |
| 1063380 | N/A | N/A | 5481 | 5496 | AGCCAACCCCATTATA | 116 | 2744 |
| 1063412 | N/A | N/A | 5653 | 5668 | GTCCAAGCCACGCAAG | 114 | 2745 |
| 1063444 | N/A | N/A | 5854 | 5869 | GGAGGCGAGTCCAGGA | 91 | 2746 |
| 1063476 | N/A | N/A | 6011 | 6026 | AGGACCGAGCTGACAT | 68 | 2747 |
| 1063508 | N/A | N/A | 6132 | 6147 | CGAGAAGTGGGTAGAT | 52 | 2748 |
| 1063540 | N/A | N/A | 6278 | 6293 | CTCGGAGTCCTATTTT | 100 | 2749 |
| 1063572 | N/A | N/A | 6440 | 6455 | GCCCACGCTAGCACAG | 69 | 2750 |
| 1063604 | N/A | N/A | 6965 | 6980 | AGGTACCCCACCCTGC | 96 | 2751 |
| 1063636 | N/A | N/A | 7170 | 7185 | CAATACGGCCTCCTCC | 83 | 2752 |
| 1063668 | N/A | N/A | 7374 | 7389 | TGCAAGCCCACATGGT | 148 | 2753 |
| 1063700 | N/A | N/A | 7800 | 7815 | GAGGTGTTACCAGGTG | 97 | 2754 |
| 1063732 | N/A | N/A | 7967 | 7982 | TGCATCTTTAAGGTTC | 28 | 2755 |
| 1063764 | N/A | N/A | 8044 | 8059 | CTTAAAGACGGCCATT | 206 | 2756 |
| 1063795 | N/A | N/A | 8558 | 8573 | CTTATTGGGATGAAGC | 221 | 2757 |
| 1063827 | N/A | N/A | 8847 | 8862 | TAGCAGGGCAAAGCAG | 107 | 2758 |
| 1063859 | N/A | N/A | 8915 | 8930 | CAGCAGCCATCTAGAG | 83 | 2759 |
| 1063891 | N/A | N/A | 9412 | 9427 | GCCTAAGTAGGGAGAA | 155 | 2760 |
| 1063923 | N/A | N/A | 9642 | 9657 | GCTACGGTCTTCCCTG | 61 | 2761 |
| 1063955 | N/A | N/A | 9938 | 9953 | GACAGATTTCCAGGTC | 94 | 2762 |
| 1063987 | N/A | N/A | 10460 | 10475 | GACCTATGTGGTTATG | 242 | 2763 |
| 1064019 | N/A | N/A | 10744 | 10759 | ACGCCCTCTTCTAAAT | 34 | 2764 |
| 1064051 | N/A | N/A | 11374 | 11389 | GCTCCTTTGCACCCTC | 55 | 2765 |
| 1064083 | N/A | N/A | 11546 | 11561 | ATGGCCCCAATCCCCA | 200 | 2766 |
| 1064117 | N/A | N/A | 11621 | 11636 | CTCCTGGAATTACTTA | 80 | 2767 |
| 1064149 | N/A | N/A | 11688 | 11703 | AGCAGTGGATAGGTGA | 62 | 2768 |
| 1064181 | N/A | N/A | 11802 | 11817 | GAAAGAAGCGGAGTA | 53 | 2769 |
| 1064213 | N/A | N/A | 11907 | 11922 | CAACACCCGTGTCCAC | 93 | 2770 |
| 1064245 | N/A | N/A | 11977 | 11992 | CAGGACCTCCTAGCTA | 147 | 2771 |
| 1064277 | N/A | N/A | 12198 | 12213 | GAATGGAGGAACCCAC | 321 | 2772 |

TABLE 40-continued

Inhibition of Foxp3 mRNA by 3-10-3 cEt gapmers targeting
SEQ ID NO: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1064309 | N/A | N/A | 12383 | 12398 | CCAGGAGAGGGTTAGG | 165 | 2773 |
| 1064341 | N/A | N/A | 12577 | 12592 | TCAAATGGGTGTTACA | 91 | 2774 |
| 1064373 | N/A | N/A | 12780 | 12795 | GTCAGCGATGATGATT | 306 | 2775 |
| 1064405 | N/A | N/A | 12923 | 12938 | AATTATCGAGTATCTT | 261 | 2776 |
| 1064437 | N/A | N/A | 13177 | 13192 | GGCTAGGGCTGAAGTG | 66 | 2777 |
| 1064469 | N/A | N/A | 13390 | 13405 | CTATGACCTACCCCGA | 214 | 2778 |

TABLE 41

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 678925 | N/A | N/A | 12902 | 12917 | TCAGGGACATGGTTAG | 75 | 2779 |
| 911144 | N/A | N/A | 7355 | 7370 | TGCTATGATCATCCCC | 33 | 65 |
| 1154721 | 84 | 99 | 484 | 499 | ACTTTGCTTTTATACC | 20 | 2780 |
| 1154727 | 336 | 351 | 6874 | 6889 | GGGCCCCGCCTCGAAG | 99 | 2781 |
| 1154733 | 1147 | 1162 | N/A | N/A | AGGAACTCTGGGAATG | 53 | 2782 |
| 1154739 | 1154 | 1169 | 12024 | 12039 | GTTGTGGAGGAACTCT | 54 | 2783 |
| 1154745 | 1255 | 1270 | 13485 | 13500 | TTGAGTGTCCGCTGCT | 16* | 2784 |
| 1154751 | 1914 | 1929 | 14324 | 14339 | AGCTTTGAGGTTGTTT | 30 | 2785 |
| 1154757 | 1931 | 1946 | 14341 | 14356 | TGATTGTGTGATGATG | 64 | 2786 |
| 1154763 | 2125 | 2140 | 14535 | 14550 | GATACACAGGTGAATT | 83 | 2787 |
| 1154769 | 2247 | 2262 | 14657 | 14672 | GGGAGTGAGGTGAGTG | 51 | 2788 |
| 1154775 | N/A | N/A | 621 | 636 | GCCGTGCCTACCTCCC | 40 | 2789 |
| 1154781 | N/A | N/A | 628 | 643 | CCCCCCCGCCGTGCCT | 66 | 2790 |
| 1154787 | N/A | N/A | 679 | 694 | GGCTGGAATCACGGTA | 64 | 2791 |
| 1154793 | N/A | N/A | 859 | 874 | TTCAAGTTGTTCAAAG | 47 | 2792 |
| 1154799 | N/A | N/A | 1106 | 1121 | TCGATGGAGTGTGGTC | 63 | 2793 |
| 1154805 | N/A | N/A | 1291 | 1306 | ACCTTGCAATCCTCCT | 43 | 2794 |
| 1154811 | N/A | N/A | 1379 | 1394 | GTGTGAAGTGCTCCCT | 31 | 2795 |
| 1154817 | N/A | N/A | 1572 | 1587 | ATTCTAATTTGGTTAC | 46 | 2796 |
| 1154823 | N/A | N/A | 1580 | 1595 | ATAGCATGATTCTAAT | 89 | 2797 |
| 1154829 | N/A | N/A | 1710 | 1725 | CAAATCAATCAAAGTT | 112 | 2798 |
| 1154835 | N/A | N/A | 1820 | 1835 | ACGCCCCCTTTGCCCC | 51 | 2799 |
| 1154841 | N/A | N/A | 1853 | 1868 | ATTAGCAGAGAGGGTC | 51 | 2800 |
| 1154847 | N/A | N/A | 2023 | 2038 | GCATGAATGGCCAATG | 73 | 2801 |

TABLE 41-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1154853 | N/A | N/A | 2155 | 2170 | TGTAATGGCTGATGAA | 28 | 2802 |
| 1154859 | N/A | N/A | 2511 | 2526 | AGTACATATGAGGAAA | 31 | 2803 |
| 1154865 | N/A | N/A | 2519 | 2534 | ACCATTGCAGTACATA | 17 | 2804 |
| 1154871 | N/A | N/A | 2622 | 2637 | AATGCTGATCTTGGGT | 59 | 2805 |
| 1154877 | N/A | N/A | 2800 | 2815 | GGAGGACCATGGAGTA | 101 | 2806 |
| 1154883 | N/A | N/A | 3037 | 3052 | TTTGCTGGTCTCTGGC | 34 | 2807 |
| 1154889 | N/A | N/A | 3218 | 3233 | GACAATTGCCCCTCTA | 54 | 2808 |
| 1154895 | N/A | N/A | 3266 | 3281 | TTCTACGCTGTCTGGT | 63 | 2809 |
| 1154901 | N/A | N/A | 3354 | 3369 | TTTCGGTGAGGCCCTG | 47 | 2810 |
| 1154907 | N/A | N/A | 3377 | 3392 | TGGATTTCAACTCTGC | 50 | 2811 |
| 1154913 | N/A | N/A | 3492 | 3507 | GGAATGGTAGCCCAGG | 54 | 2812 |
| 1154919 | N/A | N/A | 3657 | 3672 | CTGACATGCCTCCATC | 72 | 2813 |
| 1154925 | N/A | N/A | 3715 | 3730 | CCCACAATCAAGGTTT | 89 | 2814 |
| 1154931 | N/A | N/A | 4022 | 4037 | TCAGTATGTGTAGGCC | 29 | 2815 |
| 1154937 | N/A | N/A | 4247 | 4262 | ACTATGACAAGCCCCT | 63 | 2816 |
| 1154943 | N/A | N/A | 4453 | 4468 | CCCCGACTTGCCCAGA | 47 | 2817 |
| 1154949 | N/A | N/A | 4652 | 4667 | ACATTCTCAGACAGGG | 72 | 2818 |
| 1154955 | N/A | N/A | 4758 | 4773 | CATGTGGCTGGCCTGT | 92 | 2819 |
| 1154961 | N/A | N/A | 5158 | 5173 | TTCTTAGTCTCCTGGG | 40 | 2820 |
| 1154967 | N/A | N/A | 5539 | 5554 | CTTTTCAGGATCCTAT | 92 | 2821 |
| 1154973 | N/A | N/A | 5699 | 5714 | TGCTACACCCCCTGCC | 109 | 2822 |
| 1154979 | N/A | N/A | 5970 | 5985 | GAGTTGGATTGGGTGC | 52 | 2823 |
| 1154985 | N/A | N/A | 6043 | 6058 | AAGTGACATGGGTTTT | 58 | 2824 |
| 1154991 | N/A | N/A | 6070 | 6085 | GGATGTAGTGGGCAAG | 27 | 2825 |
| 1154997 | N/A | N/A | 6276 | 6291 | CGGAGTCCTATTTTGC | 90 | 2826 |
| 1155003 | N/A | N/A | 6562 | 6577 | CATAGTTGCACCCCAG | 202 | 2827 |
| 1155009 | N/A | N/A | 6648 | 6663 | GCGGTATGAGATACTC | 126 | 2828 |
| 1155015 | N/A | N/A | 7006 | 7021 | TCCCGCCCAGTGCCAC | 84 | 2829 |
| 1155021 | N/A | N/A | 7178 | 7193 | TGGGACTACAATACGG | 46 | 2830 |
| 1155027 | N/A | N/A | 7239 | 7254 | CCTACTTGGCCCCAGT | 61 | 2831 |
| 1155033 | N/A | N/A | 7315 | 7330 | CTCATGGAGATCGAGT | 92 | 2832 |
| 1155039 | N/A | N/A | 7398 | 7413 | GTGTCTAATTCAAATA | 97 | 2833 |
| 1155045 | N/A | N/A | 7903 | 7918 | GACACCTTTGACCCCC | 55 | 2834 |
| 1155051 | N/A | N/A | 7971 | 7986 | ATTCTGCATCTTTAAG | 68 | 2835 |
| 1155057 | N/A | N/A | 8002 | 8017 | TTGTAAAGCTCTGTGG | 27 | 2836 |
| 1155063 | N/A | N/A | 8050 | 8065 | GAGAAGCTTAAAGACG | 92 | 2837 |

TABLE 41-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1155069 | N/A | N/A | 8556 | 8571 | TATTGGGATGAAGCCT | 79 | 2838 |
| 1155075 | N/A | N/A | 8813 | 8828 | CTGGCTACATGGGTTC | 106 | 2839 |
| 1155081 | N/A | N/A | 9160 | 9175 | TGAGTTGAGAATGGGC | 76 | 2840 |
| 1155087 | N/A | N/A | 9420 | 9435 | CTGGCAGTGCCTAAGT | 106 | 2841 |
| 1155093 | N/A | N/A | 9602 | 9617 | TTTATACCAGCCCTCG | 82 | 2842 |
| 1155099 | N/A | N/A | 9875 | 9890 | GAATGTGAGGTTAGGT | 15 | 2843 |
| 1155105 | N/A | N/A | 10282 | 10297 | CTTAGAGTCAGAGGGT | 34 | 2844 |
| 1155111 | N/A | N/A | 10309 | 10324 | CAACTCAGGATCACAG | 32 | 2845 |
| 1155117 | N/A | N/A | 10415 | 10430 | TGGTCGCCATCTTGAA | 36 | 2846 |
| 1155123 | N/A | N/A | 10462 | 10477 | GTGACCTATGTGGTTA | 119 | 2847 |
| 1155129 | N/A | N/A | 10702 | 10717 | ACAGCATGAGCCGTAT | 93 | 2848 |
| 1155135 | N/A | N/A | 11570 | 11585 | GCTGGAGTCCAGAGTG | 81 | 2849 |
| 1155141 | N/A | N/A | 11808 | 11823 | GAGGTTGAAAAGAAGC | 53 | 2850 |
| 1155147 | N/A | N/A | 12338 | 12353 | GGTAGGTTTAGGGTCA | 80 | 2851 |
| 1155153 | N/A | N/A | 12568 | 12583 | TGTTACAAGGAAAGGT | 102 | 2852 |
| 1155159 | N/A | N/A | 12703 | 12718 | AATATCTGGTATCATG | 109 | 2853 |
| 1155165 | N/A | N/A | 12805 | 12820 | TTGGATTCAGGAATGG | 80 | 2854 |
| 1155176 | N/A | N/A | 13341 | 13356 | GGTAATCAGGGACAGG | 50 | 2855 |

TABLE 42

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 26 | 65 |
| 1154723 | 112 | 127 | 512 | 527 | TGTGGGAAACTGTCAC | 84 | 2856 |
| 1154729 | 837 | 852 | 9427 | 9442 | GGTCCGCCTGGCAGTG | 41 | 2857 |
| 1154735 | 1149 | 1164 | N/A | N/A | GGAGGAACTCTGGGAA | 75 | 2858 |
| 1154741 | 1249 | 1264 | 13479 | 13494 | GTCCGCTGCTTCTCTG | 1* | 2859 |
| 1154747 | 1908 | 1923 | 14318 | 14333 | GAGGTTGTTTGAGTGT | 17 | 2860 |
| 1154753 | 1918 | 1933 | 14328 | 14343 | ATGCAGCTTTGAGGTT | N.D. | 2861 |
| 1154759 | 1933 | 1948 | 14343 | 14358 | TGTGATTGTGTGATGA | 27 | 2862 |
| 1154765 | 2127 | 2142 | 14537 | 14552 | GAGATACACAGGTGAA | 14 | 2863 |
| 1154771 | 2249 | 2264 | 14659 | 14674 | ATGGGAGTGAGGTGAG | 44 | 2864 |
| 1154777 | N/A | N/A | 623 | 638 | CCGCCGTGCCTACCTC | 63 | 2865 |

TABLE 42-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
| --- | --- | --- | --- | --- | --- | --- | --- |
| 1154783 | N/A | N/A | 650 | 665 | CACTGTACCAGAGGGC | 72 | 2866 |
| 1154789 | N/A | N/A | 784 | 799 | TCAATTGATGAATTCA | 44 | 2867 |
| 1154795 | N/A | N/A | 862 | 877 | CATTTCAAGTTGTTCA | 30 | 2868 |
| 1154801 | N/A | N/A | 1193 | 1208 | GTGTACAAAGCTCTAG | 38 | 2869 |
| 1154807 | N/A | N/A | 1320 | 1335 | GTTCAGTTAAGTGCTC | 32 | 2870 |
| 1154813 | N/A | N/A | 1403 | 1418 | ACAGCTAAACTACGGT | 69 | 2871 |
| 1154819 | N/A | N/A | 1574 | 1589 | TGATTCTAATTTGGTT | 53 | 2872 |
| 1154825 | N/A | N/A | 1704 | 1719 | AATCAAAGTTCATGCT | 75 | 2873 |
| 1154831 | N/A | N/A | 1816 | 1831 | CCCCTTTGCCCCAGCA | 85 | 2874 |
| 1154837 | N/A | N/A | 1823 | 1838 | TGCACGCCCCCTTTGC | 103 | 2875 |
| 1154843 | N/A | N/A | 1876 | 1891 | TAGGACAACCTTTTGG | 39 | 2876 |
| 1154849 | N/A | N/A | 2071 | 2086 | TTAGGAGTAAGGACAT | 50 | 2877 |
| 1154855 | N/A | N/A | 2164 | 2179 | TGCTATATATGTAATG | 60 | 2878 |
| 1154861 | N/A | N/A | 2514 | 2529 | TGCAGTACATATGAGG | 24 | 2879 |
| 1154867 | N/A | N/A | 2614 | 2629 | TCTTGGGTTTATTGTG | 36 | 2880 |
| 1154873 | N/A | N/A | 2676 | 2691 | TCATCATATACCCTAA | 86 | 2881 |
| 1154879 | N/A | N/A | 2849 | 2864 | CCCACATATGGAGAGA | 75 | 2882 |
| 1154885 | N/A | N/A | 3039 | 3054 | CATTTGCTGGTCTCTG | 34 | 2883 |
| 1154891 | N/A | N/A | 3242 | 3257 | TAGGTGTCTGCAGGGC | 15 | 2884 |
| 1154897 | N/A | N/A | 3290 | 3305 | TGGAGTAGACAAGGGC | 36 | 2885 |
| 1154903 | N/A | N/A | 3371 | 3386 | TCAACTCTGCCGCTGC | 28 | 2886 |
| 1154909 | N/A | N/A | 3404 | 3419 | CCCACCTAGAGTCCTG | 72 | 2887 |
| 1154915 | N/A | N/A | 3653 | 3668 | CATGCCTCCATCATCA | 78 | 2888 |
| 1154921 | N/A | N/A | 3660 | 3675 | TGACTGACATGCCTCC | 65 | 2889 |
| 1154927 | N/A | N/A | 3800 | 3815 | CCTTTGGTCTGGGCCT | 37 | 2890 |
| 1154933 | N/A | N/A | 4035 | 4050 | CGGTCCCAAAGTCTCA | 43 | 2891 |
| 1154939 | N/A | N/A | 4269 | 4284 | GGTAGGTGATGTCCAT | 46 | 2892 |
| 1154945 | N/A | N/A | 4459 | 4474 | CACAGCCCCGACTTG | 60 | 2893 |
| 1154951 | N/A | N/A | 4657 | 4672 | TAGATACATTCTCAGA | 58 | 2894 |
| 1154957 | N/A | N/A | 5096 | 5111 | GGCTCCGAACAAGGGC | 85 | 2895 |
| 1154963 | N/A | N/A | 5437 | 5452 | CGTAGTCCCATAGTGA | 74 | 2896 |
| 1154969 | N/A | N/A | 5600 | 5615 | ACAATGGCTCCGGGCC | 86 | 2897 |
| 1154975 | N/A | N/A | 5766 | 5781 | TGTAGAAGCTTCTCTA | 83 | 2898 |
| 1154981 | N/A | N/A | 6035 | 6050 | TGGGTTTTAGCTTGAG | 18 | 2899 |
| 1154987 | N/A | N/A | 6049 | 6064 | GAGTCAAAGTGACATG | 57 | 2900 |
| 1154993 | N/A | N/A | 6145 | 6160 | GCAGTGGAGAAGGCGA | 74 | 2901 |

TABLE 42-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1154999 | N/A | N/A | 6292 | 6307 | TCTCGGACTTTCTCCT | 63 | 2902 |
| 1155005 | N/A | N/A | 6617 | 6632 | GTGGACACTCCTCTGG | 85 | 2903 |
| 1155011 | N/A | N/A | 7001 | 7016 | CCCAGTGCCACAGTAA | 82 | 2904 |
| 1155017 | N/A | N/A | 7008 | 7023 | CCTCCCGCCCAGTGCC | 64 | 2905 |
| 1155023 | N/A | N/A | 7189 | 7204 | AGCTATGCTCATGGGA | 46 | 2906 |
| 1155029 | N/A | N/A | 7243 | 7258 | CTCACCTACTTGGCCC | 67 | 2907 |
| 1155035 | N/A | N/A | 7351 | 7366 | ATGATCATCCCCCTTT | 66 | 2908 |
| 1155041 | N/A | N/A | 7810 | 7825 | GGTACGGGCTGAGGTG | 50 | 2909 |
| 1155047 | N/A | N/A | 7942 | 7957 | CGTTTTTTGGAGGGTG | 13 | 2910 |
| 1155053 | N/A | N/A | 7996 | 8011 | AGCTCTGTGGTTTTGT | 31 | 2911 |
| 1155059 | N/A | N/A | 8004 | 8019 | CTTTGTAAAGCTCTGT | 32 | 2912 |
| 1155065 | N/A | N/A | 8052 | 8067 | CAGAGAAGCTTAAAGA | 96 | 2913 |
| 1155071 | N/A | N/A | 8663 | 8678 | GAGGTCGAGAGAAGCT | 95 | 2914 |
| 1155077 | N/A | N/A | 8880 | 8895 | AGTGGAATAAGGCTGG | 105 | 2915 |
| 1155083 | N/A | N/A | 9326 | 9341 | TGGGAGTTCTCTCCTC | 91 | 2916 |
| 1155089 | N/A | N/A | 9422 | 9437 | GCCTGGCAGTGCCTAA | 103 | 2917 |
| 1155095 | N/A | N/A | 9607 | 9622 | CTTCCTTTATACCAGC | 44 | 2918 |
| 1155101 | N/A | N/A | 9881 | 9896 | GGACCTGAATGTGAGG | 71 | 2919 |
| 1155107 | N/A | N/A | 10302 | 10317 | GGATCACAGTGTTTGG | 4 | 2920 |
| 1155113 | N/A | N/A | 10380 | 10395 | CAGGTTACATAGCTGG | 54 | 2921 |
| 1155119 | N/A | N/A | 10420 | 10435 | CTCTGTGGTCGCCATC | 15 | 2922 |
| 1155125 | N/A | N/A | 10550 | 10565 | TCTGTACATTCGCATC | 23 | 2923 |
| 1155131 | N/A | N/A | 11156 | 11171 | TCGGATGATGCCTGGG | 85 | 2924 |
| 1155137 | N/A | N/A | 11572 | 11587 | TAGCTGGAGTCCAGAG | 74 | 2925 |
| 1155143 | N/A | N/A | 11915 | 11930 | CTCACCGTCAACACCC | 97 | 2926 |
| 1155149 | N/A | N/A | 12400 | 12415 | TAGGCTATTTTATGGG | 85 | 2927 |
| 1155155 | N/A | N/A | 12580 | 12595 | GGATCAAATGGGTGTT | 67 | 2928 |
| 1155161 | N/A | N/A | 12731 | 12746 | CAGGGTTTCAGTTCAG | 46 | 2929 |
| 1155167 | N/A | N/A | 12888 | 12903 | AGGTGGTTAGGCTCAG | 66 | 2930 |
| 1155172 | N/A | N/A | 12959 | 12974 | TGACTTGGCTTTAGGT | 96 | 2931 |
| 1155178 | N/A | N/A | 13388 | 13403 | ATGACCTACCCCGAGC | 104 | 2932 |

TABLE 43

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 24 | 65 |
| 1154724 | 144 | 159 | 544 | 559 | AAGTGGACTGACAGAA | 73 | 2933 |
| 1154730 | 838 | 853 | 9428 | 9443 | TGGTCCGCCTGGCAGT | 46 | 2934 |
| 1154736 | 1150 | 1165 | N/A | N/A | TGGAGGAACTCTGGGA | 85 | 2935 |
| 1154742 | 1250 | 1265 | 13480 | 13495 | TGTCCGCTGCTTCTCT | 8* | 2936 |
| 1154748 | 1909 | 1924 | 14319 | 14334 | TGAGGTTGTTTGAGTG | 35 | 2937 |
| 1154754 | 1928 | 1943 | 14338 | 14353 | TTGTGTGATGATGCAG | 4 | 2938 |
| 1154760 | 1935 | 1950 | 14345 | 14360 | TGTGTGATTGTGTGAT | 57 | 2939 |
| 1154766 | 2243 | 2258 | 14653 | 14668 | GTGAGGTGAGTGGCAG | 49 | 2940 |
| 1154772 | 2267 | 2282 | N/A | N/A | TGGATCAGGGCTCAGG | 34 | 2941 |
| 1154778 | N/A | N/A | 625 | 640 | CCCCGCCGTGCCTACC | 26 | 2942 |
| 1154784 | N/A | N/A | 656 | 671 | ACATCCCACTGTACCA | 78 | 2943 |
| 1154790 | N/A | N/A | 786 | 801 | TATCAATTGATGAATT | 134 | 2944 |
| 1154796 | N/A | N/A | 864 | 879 | AGCATTTCAAGTTGTT | 47 | 2945 |
| 1154802 | N/A | N/A | 1270 | 1285 | TAGGGTGAACAGAACT | 79 | 2946 |
| 1154808 | N/A | N/A | 1321 | 1336 | AGTTCAGTTAAGTGCT | 63 | 2947 |
| 1154814 | N/A | N/A | 1470 | 1485 | TGAACAACCTGTTTGC | 104 | 2948 |
| 1154820 | N/A | N/A | 1575 | 1590 | ATGATTCTAATTTGGT | 41 | 2949 |
| 1154826 | N/A | N/A | 1707 | 1722 | ATCAATCAAAGTTCAT | 47 | 2950 |
| 1154832 | N/A | N/A | 1817 | 1832 | CCCCCTTTGCCCCAGC | 47 | 2951 |
| 1154838 | N/A | N/A | 1824 | 1839 | ATGCACGCCCCCTTTG | 108 | 2952 |
| 1154844 | N/A | N/A | 1902 | 1917 | TTAGCTTAAGTAGAGG | 43 | 2953 |
| 1154850 | N/A | N/A | 2150 | 2165 | TGGCTGATGAAAGGTT | 48 | 2954 |
| 1154856 | N/A | N/A | 2165 | 2180 | TTGCTATATATGTAAT | 104 | 2955 |
| 1154862 | N/A | N/A | 2515 | 2530 | TTGCAGTACATATGAG | 77 | 2956 |
| 1154868 | N/A | N/A | 2617 | 2632 | TGATCTTGGGTTTATT | 58 | 2957 |
| 1154874 | N/A | N/A | 2789 | 2804 | GAGTATGGTTTAACAA | 63 | 2958 |
| 1154880 | N/A | N/A | 2906 | 2921 | CCCTGGTATAAGAACA | 112 | 2959 |
| 1154886 | N/A | N/A | 3044 | 3059 | AAGAACATTTGCTGGT | 44 | 2960 |
| 1154892 | N/A | N/A | 3243 | 3258 | TTAGGTGTCTGCAGGG | 69 | 2961 |
| 1154898 | N/A | N/A | 3291 | 3306 | GTGGAGTAGACAAGGG | 21 | 2962 |
| 1154904 | N/A | N/A | 3372 | 3387 | TTCAACTCTGCCGCTG | 48 | 2963 |
| 1154910 | N/A | N/A | 3411 | 3426 | CCAGGGTCCCACCTAG | 115 | 2964 |
| 1154916 | N/A | N/A | 3654 | 3669 | ACATGCCTCCATCATC | 70 | 2965 |
| 1154922 | N/A | N/A | 3661 | 3676 | CTGACTGACATGCCTC | 56 | 2966 |
| 1154928 | N/A | N/A | 4017 | 4032 | ATGTGTAGGCCAGTGT | 31 | 2967 |

TABLE 43-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1154934 | N/A | N/A | 4037 | 4052 | TACGGTCCCAAAGTCT | 97 | 2968 |
| 1154940 | N/A | N/A | 4270 | 4285 | TGGTAGGTGATGTCCA | 96 | 2969 |
| 1154946 | N/A | N/A | 4508 | 4523 | GGACACAGATTATGTT | 90 | 2970 |
| 1154952 | N/A | N/A | 4658 | 4673 | ATAGATACATTCTCAG | 50 | 2971 |
| 1154958 | N/A | N/A | 5097 | 5112 | AGGCTCCGAACAAGGG | 75 | 2972 |
| 1154964 | N/A | N/A | 5531 | 5546 | GATCCTATAATCCTGG | 96 | 2973 |
| 1154970 | N/A | N/A | 5601 | 5616 | CACAATGGCTCCGGGC | 74 | 2974 |
| 1154976 | N/A | N/A | 5914 | 5929 | AATATGTGAGTGGAGG | 68 | 2975 |
| 1154982 | N/A | N/A | 6038 | 6053 | ACATGGGTTTTAGCTT | 62 | 2976 |
| 1154988 | N/A | N/A | 6051 | 6066 | GAGAGTCAAAGTGACA | 74 | 2977 |
| 1154994 | N/A | N/A | 6189 | 6204 | AACAGTCCTGGCAAGT | 129 | 2978 |
| 1155000 | N/A | N/A | 6308 | 6323 | ATCTTGCCGGAGCTGG | 68 | 2979 |
| 1155006 | N/A | N/A | 6618 | 6633 | CGTGGACACTCCTCTG | 93 | 2980 |
| 1155012 | N/A | N/A | 7002 | 7017 | GCCCAGTGCCACAGTA | 104 | 2981 |
| 1155018 | N/A | N/A | 7009 | 7024 | CCCTCCCGCCCAGTGC | 67 | 2982 |
| 1155024 | N/A | N/A | 7190 | 7205 | TAGCTATGCTCATGGG | 47 | 2983 |
| 1155030 | N/A | N/A | 7304 | 7319 | CGAGTAACTTTTTAAA | 103 | 2984 |
| 1155036 | N/A | N/A | 7353 | 7368 | CTATGATCATCCCCCT | 64 | 2985 |
| 1155042 | N/A | N/A | 7885 | 7900 | AGTACTGCAATTCAGA | 57 | 2986 |
| 1155048 | N/A | N/A | 7965 | 7980 | CATCTTTAAGGTTCTG | 16 | 2987 |
| 1155054 | N/A | N/A | 7997 | 8012 | AAGCTCTGTGGTTTTG | 49 | 2988 |
| 1155060 | N/A | N/A | 8014 | 8029 | TTTTGACTAGCTTTGT | 45 | 2989 |
| 1155066 | N/A | N/A | 8053 | 8068 | GCAGAGAAGCTTAAAG | 79 | 2990 |
| 1155072 | N/A | N/A | 8664 | 8679 | TGAGGTCGAGAGAAGC | 121 | 2991 |
| 1155078 | N/A | N/A | 8883 | 8898 | AACAGTGGAATAAGGC | 65 | 2992 |
| 1155084 | N/A | N/A | 9329 | 9344 | CTCTGGGAGTTCTCTC | 85 | 2993 |
| 1155090 | N/A | N/A | 9423 | 9438 | CGCCTGGCAGTGCCTA | 89 | 2994 |
| 1155096 | N/A | N/A | 9608 | 9623 | CCTTCCTTTATACCAG | 102 | 2995 |
| 1155102 | N/A | N/A | 9954 | 9969 | TTTGTAAGTAGAAGGG | 32 | 2996 |
| 1155108 | N/A | N/A | 10303 | 10318 | AGGATCACAGTGTTTG | 18 | 2997 |
| 1155114 | N/A | N/A | 10412 | 10427 | TCGCCATCTTGAAATC | 57 | 2998 |
| 1155120 | N/A | N/A | 10421 | 10436 | GCTCTGTGGTCGCCAT | 34 | 2999 |
| 1155126 | N/A | N/A | 10584 | 10599 | GTCACCTAAACCCCCC | 54 | 3000 |
| 1155132 | N/A | N/A | 11322 | 11337 | CCGTGTAGTGCAAGGA | 106 | 3001 |
| 1155138 | N/A | N/A | 11574 | 11589 | AGTAGCTGGAGTCCAG | 42 | 3002 |
| 1155144 | N/A | N/A | 12285 | 12300 | TTGGATTTGCGGACAG | 57 | 3003 |

TABLE 43-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1155150 | N/A | N/A | 12550 | 12565 | GGAATGGTGCCCAGTT | 105 | 3004 |
| 1155156 | N/A | N/A | 12700 | 12715 | ATCTGGTATCATGTAG | 80 | 3005 |
| 1155162 | N/A | N/A | 12758 | 12773 | AGGCTATCAGTCAGGA | 74 | 3006 |
| 1155168 | N/A | N/A | 12894 | 12909 | ATGGTTAGGTGGTTAG | 92 | 3007 |
| 1155173 | N/A | N/A | 12966 | 12981 | GATGGGATGACTTGGC | 76 | 3008 |
| 1155179 | N/A | N/A | 13391 | 13406 | GCTATGACCTACCCCG | 96 | 3009 |

TABLE 44

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 30 | 65 |
| 1154725 | 152 | 167 | N/A | N/A | GCTTGGTGAAGTGGAC | 48 | 3010 |
| 1154731 | 839 | 854 | 9429 | 9444 | ATGGTCCGCCTGGCAG | 48 | 3011 |
| 1154737 | 1152 | 1167 | N/A | N/A | TGTGGAGGAACTCTGG | 74 | 3012 |
| 1154743 | 1252 | 1267 | 13482 | 13497 | AGTGTCCGCTGCTTCT | 7* | 3013 |
| 1154749 | 1911 | 1926 | 14321 | 14336 | TTTGAGGTTGTTTGAG | 40 | 3014 |
| 1154755 | 1929 | 1944 | 14339 | 14354 | ATTGTGTGATGATGCA | 38 | 3015 |
| 1154761 | 2066 | 2081 | 14476 | 14491 | ATCCTGAGGGTACTGA | 75 | 3016 |
| 1154767 | 2244 | 2259 | 14654 | 14669 | AGTGAGGTGAGTGGCA | 33 | 3017 |
| 1154773 | N/A | N/A | 619 | 634 | CGTGCCTACCTCCCTG | 48 | 3018 |
| 1154779 | N/A | N/A | 626 | 641 | CCCCCGCCGTGCCTAC | 33 | 3019 |
| 1154785 | N/A | N/A | 660 | 675 | GGGTACATCCCACTGT | 83 | 3020 |
| 1154791 | N/A | N/A | 787 | 802 | GTATCAATTGATGAAT | 100 | 3021 |
| 1154797 | N/A | N/A | 865 | 880 | CAGCATTTCAAGTTGT | 71 | 3022 |
| 1154803 | N/A | N/A | 1277 | 1292 | CTGCTACTAGGGTGAA | 22 | 3023 |
| 1154809 | N/A | N/A | 1322 | 1337 | AAGTTCAGTTAAGTGC | 38 | 3024 |
| 1154815 | N/A | N/A | 1523 | 1538 | TACTTTGTGCCAAACG | 62 | 3025 |
| 1154821 | N/A | N/A | 1578 | 1593 | AGCATGATTCTAATTT | 28 | 3026 |
| 1154827 | N/A | N/A | 1708 | 1723 | AATCAATCAAAGTTCA | 76 | 3027 |
| 1154833 | N/A | N/A | 1818 | 1833 | GCCCCCTTTGCCCCAG | 26 | 3028 |
| 1154839 | N/A | N/A | 1825 | 1840 | AATGCACGCCCCCTTT | 108 | 3029 |
| 1154845 | N/A | N/A | 1906 | 1921 | AGGGTTAGCTTAAGTA | 40 | 3030 |
| 1154851 | N/A | N/A | 2152 | 2167 | AATGGCTGATGAAAGG | 39 | 3031 |
| 1154857 | N/A | N/A | 2190 | 2205 | GCAAATGATGAATTGG | 34 | 3032 |

TABLE 44-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1154863 | N/A | N/A | 2516 | 2531 | ATTGCAGTACATATGA | 52 | 3033 |
| 1154869 | N/A | N/A | 2620 | 2635 | TGCTGATCTTGGGTTT | 33 | 3034 |
| 1154875 | N/A | N/A | 2792 | 2807 | ATGGAGTATGGTTTAA | 23 | 3035 |
| 1154881 | N/A | N/A | 2968 | 2983 | AGGGACACCCATGGCT | 87 | 3036 |
| 1154887 | N/A | N/A | 3045 | 3060 | TAAGAACATTTGCTGG | 33 | 3037 |
| 1154893 | N/A | N/A | 3250 | 3265 | TAAGTCATTAGGTGTC | 21 | 3038 |
| 1154899 | N/A | N/A | 3314 | 3329 | TTCTACACTGAGCACG | 49 | 3039 |
| 1154905 | N/A | N/A | 3373 | 3388 | TTTCAACTCTGCCGCT | 79 | 3040 |
| 1154911 | N/A | N/A | 3412 | 3427 | ACCAGGGTCCCACCTA | 112 | 3041 |
| 1154917 | N/A | N/A | 3655 | 3670 | GACATGCCTCCATCAT | 51 | 3042 |
| 1154923 | N/A | N/A | 3662 | 3677 | ACTGACTGACATGCCT | 55 | 3043 |
| 1154929 | N/A | N/A | 4018 | 4033 | TATGTGTAGGCCAGTG | 11 | 3044 |
| 1154935 | N/A | N/A | 4226 | 4241 | TGAAGACCTGGCCCTT | 90 | 3045 |
| 1154941 | N/A | N/A | 4273 | 4288 | ATGTGGTAGGTGATGT | 45 | 3046 |
| 1154947 | N/A | N/A | 4609 | 4624 | AGGACCTAGAGGGCCG | 122 | 3047 |
| 1154953 | N/A | N/A | 4663 | 4678 | AAAGCATAGATACATT | 69 | 3048 |
| 1154959 | N/A | N/A | 5098 | 5113 | GAGGCTCCGAACAAGG | 57 | 3049 |
| 1154965 | N/A | N/A | 5532 | 5547 | GGATCCTATAATCCTG | 114 | 3050 |
| 1154971 | N/A | N/A | 5603 | 5618 | TCCACAATGGCTCCGG | 72 | 3051 |
| 1154977 | N/A | N/A | 5944 | 5959 | GTGTAGATAGACATGA | 91 | 3052 |
| 1154983 | N/A | N/A | 6039 | 6054 | GACATGGGTTTTAGCT | 63 | 3053 |
| 1154989 | N/A | N/A | 6052 | 6067 | GGAGAGTCAAAGTGAC | 81 | 3054 |
| 1154995 | N/A | N/A | 6268 | 6283 | TATTTTGCCCCAGTGA | 60 | 3055 |
| 1155001 | N/A | N/A | 6396 | 6411 | GCAATGGTTGTTTCCC | 38 | 3056 |
| 1155007 | N/A | N/A | 6641 | 6656 | GAGATACTCGACCACC | 59 | 3057 |
| 1155013 | N/A | N/A | 7003 | 7018 | CGCCCAGTGCCACAGT | 78 | 3058 |
| 1155019 | N/A | N/A | 7092 | 7107 | GGATTTTCTTGGCCCT | 94 | 3059 |
| 1155025 | N/A | N/A | 7192 | 7207 | CATAGCTATGCTCATG | 99 | 3060 |
| 1155031 | N/A | N/A | 7313 | 7328 | CATGGAGATCGAGTAA | 25 | 3061 |
| 1155037 | N/A | N/A | 7358 | 7373 | AGATGCTATGATCATC | 114 | 3062 |
| 1155043 | N/A | N/A | 7900 | 7915 | ACCTTTGACCCCCAGA | 61 | 3063 |
| 1155049 | N/A | N/A | 7969 | 7984 | TCTGCATCTTTAAGGT | 89 | 3064 |
| 1155055 | N/A | N/A | 7998 | 8013 | AAAGCTCTGTGGTTTT | 57 | 3065 |
| 1155061 | N/A | N/A | 8016 | 8031 | CATTTTGACTAGCTTT | 48 | 3066 |
| 1155067 | N/A | N/A | 8192 | 8207 | ACAGGGCACCTATGGA | 85 | 3067 |
| 1155073 | N/A | N/A | 8691 | 8706 | CGTTTCTTATTATACA | 75 | 3068 |

TABLE 44-continued

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1155079 | N/A | N/A | 8890 | 8905 | CTTTGGGAACAGTGGA | 83 | 3069 |
| 1155085 | N/A | N/A | 9331 | 9346 | CCCTCTGGGAGTTCTC | 99 | 3070 |
| 1155091 | N/A | N/A | 9424 | 9439 | CCGCCTGGCAGTGCCT | 41 | 3071 |
| 1155097 | N/A | N/A | 9609 | 9624 | TCCTTCCTTTATACCA | 71 | 3072 |
| 1155103 | N/A | N/A | 9959 | 9974 | GAGGGTTTGTAAGTAG | 94 | 3073 |
| 1155109 | N/A | N/A | 10304 | 10319 | CAGGATCACAGTGTTT | 12 | 3074 |
| 1155115 | N/A | N/A | 10413 | 10428 | GTCGCCATCTTGAAAT | 54 | 3075 |
| 1155121 | N/A | N/A | 10422 | 10437 | TGCTCTGTGGTCGCCA | 27 | 3076 |
| 1155127 | N/A | N/A | 10609 | 10624 | ACCACCCAACTGTGAC | 88 | 3077 |
| 1155133 | N/A | N/A | 11424 | 11439 | TGAGTGGCGGCAGCTG | 91 | 3078 |
| 1155139 | N/A | N/A | 11576 | 11591 | ATAGTAGCTGGAGTCC | 35 | 3079 |
| 1155145 | N/A | N/A | 12298 | 12313 | TGGTGGTTTAGGTTTG | 68 | 3080 |
| 1155151 | N/A | N/A | 12564 | 12579 | ACAAGGAAAGGTTGGG | 84 | 3081 |
| 1155157 | N/A | N/A | 12701 | 12716 | TATCTGGTATCATGTA | 110 | 3082 |
| 1155163 | N/A | N/A | 12759 | 12774 | GAGGCTATCAGTCAGG | 62 | 3083 |
| 1155169 | N/A | N/A | 12896 | 12911 | ACATGGTTAGGTGGTT | 93 | 3084 |
| 1155174 | N/A | N/A | 13278 | 13293 | GGTGAAGTGTCGGGTT | 58 | 3085 |
| 1155180 | N/A | N/A | 13392 | 13407 | GGCTATGACCTACCCC | N.D. | 3086 |

TABLE 45

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 25 | 65 |
| 1154726 | 335 | 350 | 6873 | 6888 | GGCCCCGCCTCGAAGA | 62 | 3087 |
| 1154732 | 1146 | 1161 | N/A | N/A | GGAACTCTGGGAATGT | 40 | 3088 |
| 1154738 | 1153 | 1168 | 12023 | 12038 | TTGTGGAGGAACTCTG | 71 | 3089 |
| 1154744 | 1254 | 1269 | 13484 | 13499 | TGAGTGTCCGCTGCTT | 24* | 3090 |
| 1154750 | 1912 | 1927 | 14322 | 14337 | CTTTGAGGTTGTTTGA | 37 | 3091 |
| 1154756 | 1930 | 1945 | 14340 | 14355 | GATTGTGTGATGATGC | 25 | 3092 |
| 1154762 | 2067 | 2082 | 14477 | 14492 | GATCCTGAGGGTACTG | 55 | 3093 |
| 1154768 | 2246 | 2261 | 14656 | 14671 | GGAGTGAGGTGAGTGG | 41 | 3094 |
| 1154774 | N/A | N/A | 620 | 635 | CCGTGCCTACCTCCCT | 39 | 3095 |
| 1154780 | N/A | N/A | 627 | 642 | CCCCCCGCCGTGCCTA | 54 | 3096 |

TABLE 45-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1154786 | N/A | N/A | 662 | 677 | CTGGGTACATCCCACT | 98 | 3097 |
| 1154792 | N/A | N/A | 858 | 873 | TCAAGTTGTTCAAAGC | 37 | 3098 |
| 1154798 | N/A | N/A | 968 | 983 | GCAAGACAGGGTGAGC | 91 | 3099 |
| 1154804 | N/A | N/A | 1288 | 1303 | TTGCAATCCTCCTGCT | 95 | 3100 |
| 1154810 | N/A | N/A | 1323 | 1338 | AAAGTTCAGTTAAGTG | 60 | 3101 |
| 1154816 | N/A | N/A | 1562 | 1577 | GGTTACAGAAATACTA | 84 | 3102 |
| 1154822 | N/A | N/A | 1579 | 1594 | TAGCATGATTCTAATT | 66 | 3103 |
| 1154828 | N/A | N/A | 1709 | 1724 | AAATCAATCAAAGTTC | N.D. | 3104 |
| 1154834 | N/A | N/A | 1819 | 1834 | CGCCCCTTTGCCCCA | 45 | 3105 |
| 1154840 | N/A | N/A | 1844 | 1859 | GAGGGTCATAAACTTT | 66 | 3106 |
| 1154846 | N/A | N/A | 1913 | 1928 | CTCACCTAGGGTTAGC | 76 | 3107 |
| 1154852 | N/A | N/A | 2153 | 2168 | TAATGGCTGATGAAAG | 80 | 3108 |
| 1154858 | N/A | N/A | 2247 | 2262 | GACTGTATAAAACCAT | 20 | 3109 |
| 1154864 | N/A | N/A | 2518 | 2533 | CCATTGCAGTACATAT | 27 | 3110 |
| 1154870 | N/A | N/A | 2621 | 2636 | ATGCTGATCTTGGGTT | 45 | 3111 |
| 1154876 | N/A | N/A | 2795 | 2810 | ACCATGGAGTATGGTT | 102 | 3112 |
| 1154882 | N/A | N/A | 3036 | 3051 | TTGCTGGTCTCTGGCT | 74 | 3113 |
| 1154888 | N/A | N/A | 3094 | 3109 | ATGCATGGAGAGCCAG | 91 | 3114 |
| 1154894 | N/A | N/A | 3263 | 3278 | TACGCTGTCTGGTTAA | 60 | 3115 |
| 1154900 | N/A | N/A | 3353 | 3368 | TTCGGTGAGGCCCTGA | 70 | 3116 |
| 1154906 | N/A | N/A | 3374 | 3389 | ATTTCAACTCTGCCGC | 46 | 3117 |
| 1154912 | N/A | N/A | 3490 | 3505 | AATGGTAGCCCAGGTT | 63 | 3118 |
| 1154918 | N/A | N/A | 3656 | 3671 | TGACATGCCTCCATCA | 75 | 3119 |
| 1154924 | N/A | N/A | 3712 | 3727 | ACAATCAAGGTTTTCG | 21 | 3120 |
| 1154930 | N/A | N/A | 4021 | 4036 | CAGTATGTGTAGGCCA | 11 | 3121 |
| 1154936 | N/A | N/A | 4231 | 4246 | AGCTCTGAAGACCTGG | 62 | 3122 |
| 1154942 | N/A | N/A | 4451 | 4466 | CCGACTTGCCCAGATT | 68 | 3123 |
| 1154948 | N/A | N/A | 4638 | 4653 | GGACATGGAGATGATC | 78 | 3124 |
| 1154954 | N/A | N/A | 4664 | 4679 | CAAAGCATAGATACAT | 66 | 3125 |
| 1154960 | N/A | N/A | 5104 | 5119 | TCTGTGGAGGCTCCGA | 72 | 3126 |
| 1154966 | N/A | N/A | 5535 | 5550 | TCAGGATCCTATAATC | 84 | 3127 |
| 1154972 | N/A | N/A | 5604 | 5619 | CTCCACAATGGCTCCG | 68 | 3128 |
| 1154978 | N/A | N/A | 5946 | 5961 | AGGTGTAGATAGACAT | 45 | 3129 |
| 1154984 | N/A | N/A | 6040 | 6055 | TGACATGGGTTTTAGC | 48 | 3130 |
| 1154990 | N/A | N/A | 6069 | 6084 | GATGTAGTGGGCAAGA | 55 | 3131 |
| 1154996 | N/A | N/A | 6275 | 6290 | GGAGTCCTATTTTGCC | 67 | 3132 |

TABLE 45-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1155002 | N/A | N/A | 6499 | 6514 | AGGTACATGTACATAC | 74 | 3133 |
| 1155008 | N/A | N/A | 6647 | 6662 | CGGTATGAGATACTCG | 79 | 3134 |
| 1155014 | N/A | N/A | 7004 | 7019 | CCGCCCAGTGCCACAG | 73 | 3135 |
| 1155020 | N/A | N/A | 7177 | 7192 | GGGACTACAATACGGC | 32 | 3136 |
| 1155026 | N/A | N/A | 7194 | 7209 | CACATAGCTATGCTCA | 38 | 3137 |
| 1155032 | N/A | N/A | 7314 | 7329 | TCATGGAGATCGAGTA | 16 | 3138 |
| 1155038 | N/A | N/A | 7359 | 7374 | TAGATGCTATGATCAT | 58 | 3139 |
| 1155044 | N/A | N/A | 7901 | 7916 | CACCTTTGACCCCCAG | 40 | 3140 |
| 1155050 | N/A | N/A | 7970 | 7985 | TTCTGCATCTTTAAGG | 59 | 3141 |
| 1155056 | N/A | N/A | 7999 | 8014 | TAAAGCTCTGTGGTTT | 86 | 3142 |
| 1155062 | N/A | N/A | 8022 | 8037 | TGCTGACATTTTGACT | 74 | 3143 |
| 1155068 | N/A | N/A | 8498 | 8513 | CCGGTAGACTGGCACA | 94 | 3144 |
| 1155074 | N/A | N/A | 8811 | 8826 | GGCTACATGGGTTCAA | 89 | 3145 |
| 1155080 | N/A | N/A | 9124 | 9139 | AAGCATTCTGGGTGGA | 53 | 3146 |
| 1155086 | N/A | N/A | 9389 | 9404 | TGCAGGTGACCACGAC | 74 | 3147 |
| 1155092 | N/A | N/A | 9552 | 9567 | CAGAAGGTTTTGCGCA | 50 | 3148 |
| 1155098 | N/A | N/A | 9874 | 9889 | AATGTGAGGTTAGGTT | 40 | 3149 |
| 1155104 | N/A | N/A | 10281 | 10296 | TTAGAGTCAGAGGGTT | 28 | 3150 |
| 1155110 | N/A | N/A | 10308 | 10323 | AACTCAGGATCACAGT | 79 | 3151 |
| 1155116 | N/A | N/A | 10414 | 10429 | GGTCGCCATCTTGAAA | 37 | 3152 |
| 1155122 | N/A | N/A | 10459 | 10474 | ACCTATGTGGTTATGT | 80 | 3153 |
| 1155128 | N/A | N/A | 10653 | 10668 | CCACTGATGCTGGGAC | 88 | 3154 |
| 1155134 | N/A | N/A | 11508 | 11523 | GACACTCGAGACCATA | 66 | 3155 |
| 1155140 | N/A | N/A | 11789 | 11804 | GTAACTTGCACACCAA | 62 | 3156 |
| 1155146 | N/A | N/A | 12304 | 12319 | CCTGGATGGTGGTTTA | 64 | 3157 |
| 1155152 | N/A | N/A | 12567 | 12582 | GTTACAAGGAAAGGTT | 103 | 3158 |
| 1155158 | N/A | N/A | 12702 | 12717 | ATATCTGGTATCATGT | 82 | 3159 |
| 1155164 | N/A | N/A | 12769 | 12784 | TGATTGCAGTGAGGCT | 102 | 3160 |
| 1155170 | N/A | N/A | 12900 | 12915 | AGGGACATGGTTAGGT | 66 | 3161 |
| 1155175 | N/A | N/A | 13340 | 13355 | GTAATCAGGGACAGGA | 107 | 3162 |
| 1155181 | N/A | N/A | 13421 | 13436 | GCACATTCCCCAAACT | 107 | 3163 |

TABLE 46

Inhibition of Foxp3 mRNA by 3-10-3 cEt gapmers targeting
SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 911144 | N/A | N/A | 7355 | 7370 | TGCTATGATCATCCCC | 27 | 65 |
| 1154722 | 85 | 100 | 485 | 500 | AACTTTGCTTTTATAC | N.D. | 3164 |
| 1154728 | 836 | 851 | 9426 | 9441 | GTCCGCCTGGCAGTGC | 51 | 3165 |
| 1154734 | 1148 | 1163 | N/A | N/A | GAGGAACTCTGGGAAT | 65 | 3166 |
| 1154740 | 1155 | 1170 | 12025 | 12040 | TGTTGTGGAGGAACTC | 83 | 3167 |
| 1154746 | 1905 | 1920 | 14315 | 14330 | GTTGTTTGAGTGTACT | 67 | 3168 |
| 1154752 | 1916 | 1931 | 14326 | 14341 | GCAGCTTTGAGGTTGT | 49 | 3169 |
| 1154758 | 1932 | 1947 | 14342 | 14357 | GTGATTGTGTGATGAT | 20 | 3170 |
| 1154764 | 2126 | 2141 | 14536 | 14551 | AGATACACAGGTGAAT | 48 | 3171 |
| 1154770 | 2248 | 2263 | 14658 | 14673 | TGGGAGTGAGGTGAGT | 57 | 3172 |
| 1154776 | N/A | N/A | 622 | 637 | CGCCGTGCCTACCTCC | 43 | 3173 |
| 1154782 | N/A | N/A | 649 | 664 | ACTGTACCAGAGGGCC | 77 | 3174 |
| 1154788 | N/A | N/A | 783 | 798 | CAATTGATGAATTCAT | 86 | 3175 |
| 1154794 | N/A | N/A | 861 | 876 | ATTTCAAGTTGTTCAA | 55 | 3176 |
| 1154800 | N/A | N/A | 1192 | 1207 | TGTACAAAGCTCTAGG | 32 | 3177 |
| 1154806 | N/A | N/A | 1313 | 1328 | TAAGTGCTCAGCTTGC | 71 | 3178 |
| 1154812 | N/A | N/A | 1385 | 1400 | ACAATGGTGTGAAGTG | 42 | 3179 |
| 1154818 | N/A | N/A | 1573 | 1588 | GATTCTAATTTGGTTA | 41 | 3180 |
| 1154824 | N/A | N/A | 1581 | 1596 | TATAGCATGATTCTAA | 67 | 3181 |
| 1154830 | N/A | N/A | 1729 | 1744 | CCAACAATCGGCACTT | 49 | 3182 |
| 1154836 | N/A | N/A | 1822 | 1837 | GCACGCCCCTTTGCC | 46 | 3183 |
| 1154842 | N/A | N/A | 1872 | 1887 | ACAACCTTTTGGAAGG | 85 | 3184 |
| 1154848 | N/A | N/A | 2027 | 2042 | AAAAGCATGAATGGCC | 72 | 3185 |
| 1154854 | N/A | N/A | 2161 | 2176 | TATATATGTAATGGCT | 40 | 3186 |
| 1154860 | N/A | N/A | 2513 | 2528 | GCAGTACATATGAGGA | 21 | 3187 |
| 1154866 | N/A | N/A | 2531 | 2546 | GGTACTATTATAACCA | 97 | 3188 |
| 1154872 | N/A | N/A | 2637 | 2652 | TAAGTTTTAACACCTA | 69 | 3189 |
| 1154878 | N/A | N/A | 2837 | 2852 | GAGAACTGAATTTGTG | 22 | 3190 |
| 1154884 | N/A | N/A | 3038 | 3053 | ATTTGCTGGTCTCTGG | 8 | 3191 |
| 1154890 | N/A | N/A | 3225 | 3240 | TCAAGTTGACAATTGC | 54 | 3192 |
| 1154896 | N/A | N/A | 3289 | 3304 | GGAGTAGACAAGGGCC | 14 | 3193 |
| 1154902 | N/A | N/A | 3363 | 3378 | GCCGCTGCATTTCGGT | 74 | 3194 |
| 1154908 | N/A | N/A | 3378 | 3393 | TTGGATTTCAACTCTG | 44 | 3195 |
| 1154914 | N/A | N/A | 3613 | 3628 | CTGACCTATGGAGTCC | 73 | 3196 |
| 1154920 | N/A | N/A | 3659 | 3674 | GACTGACATGCCTCCA | 42 | 3197 |
| 1154926 | N/A | N/A | 3717 | 3732 | GCCCCACAATCAAGGT | 91 | 3198 |

TABLE 46-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1154932 | N/A | N/A | 4031 | 4046 | CCCAAAGTCTCAGTAT | 92 | 3199 |
| 1154938 | N/A | N/A | 4250 | 4265 | GCCACTATGACAAGCC | 71 | 3200 |
| 1154944 | N/A | N/A | 4458 | 4473 | ACAGCCCCGACTTGC | 123 | 3201 |
| 1154950 | N/A | N/A | 4656 | 4671 | AGATACATTCTCAGAC | 49 | 3202 |
| 1154956 | N/A | N/A | 4785 | 4800 | GATGTTTTCCACCACT | 15 | 3203 |
| 1154962 | N/A | N/A | 5216 | 5231 | GGGTGGTTGTCAGAGC | 17 | 3204 |
| 1154968 | N/A | N/A | 5554 | 5569 | TGAGGGAAGCACTGGC | 42 | 3205 |
| 1154974 | N/A | N/A | 5700 | 5715 | ATGCTACACCCCTGC | 74 | 3206 |
| 1154980 | N/A | N/A | 5971 | 5986 | GGAGTTGGATTGGGTG | 33 | 3207 |
| 1154986 | N/A | N/A | 6047 | 6062 | GTCAAAGTGACATGGG | 39 | 3208 |
| 1154992 | N/A | N/A | 6092 | 6107 | TCAGGAGCAGTGCTAG | 79 | 3209 |
| 1154998 | N/A | N/A | 6277 | 6292 | TCGGAGTCCTATTTTG | 63 | 3210 |
| 1155004 | N/A | N/A | 6607 | 6622 | CTCTGGTCAAAGCAGG | 74 | 3211 |
| 1155010 | N/A | N/A | 7000 | 7015 | CCAGTGCCACAGTAAA | 66 | 3212 |
| 1155016 | N/A | N/A | 7007 | 7022 | CTCCCGCCCAGTGCCA | 51 | 3213 |
| 1155022 | N/A | N/A | 7179 | 7194 | ATGGGACTACAATACG | 25 | 3214 |
| 1155028 | N/A | N/A | 7242 | 7257 | TCACCTACTTGGCCCC | 68 | 3215 |
| 1155034 | N/A | N/A | 7350 | 7365 | TGATCATCCCCCTTTT | 70 | 3216 |
| 1155040 | N/A | N/A | 7633 | 7648 | CTGTGGTTCAGCCTGA | 64 | 3217 |
| 1155046 | N/A | N/A | 7929 | 7944 | GTGGAGTTTCCAAGCC | 40 | 3218 |
| 1155052 | N/A | N/A | 7995 | 8010 | GCTCTGTGGTTTTGTG | 19 | 3219 |
| 1155058 | N/A | N/A | 8003 | 8018 | TTTGTAAAGCTCTGTG | 22 | 3220 |
| 1155064 | N/A | N/A | 8051 | 8066 | AGAGAAGCTTAAAGAC | 73 | 3221 |
| 1155070 | N/A | N/A | 8569 | 8584 | GCATCTTACTACTTAT | 24 | 3222 |
| 1155076 | N/A | N/A | 8827 | 8842 | GCAGATTCTAGAGCCT | 57 | 3223 |
| 1155082 | N/A | N/A | 9175 | 9190 | ATGTTGGAAGTGTGGT | 69 | 3224 |
| 1155088 | N/A | N/A | 9421 | 9436 | CCTGGCAGTGCCTAAG | 79 | 3225 |
| 1155094 | N/A | N/A | 9606 | 9621 | TTCCTTTATACCAGCC | 62 | 3226 |
| 1155100 | N/A | N/A | 9876 | 9891 | TGAATGTGAGGTTAGG | 6 | 3227 |
| 1155106 | N/A | N/A | 10286 | 10301 | GGATCTTAGAGTCAGA | 20 | 3228 |
| 1155112 | N/A | N/A | 10372 | 10387 | ATAGCTGGTCCTGCTG | 105 | 3229 |
| 1155118 | N/A | N/A | 10417 | 10432 | TGTGGTCGCCATCTTG | 23 | 3230 |
| 1155124 | N/A | N/A | 10549 | 10564 | CTGTACATTCGCATCA | 35 | 3231 |
| 1155130 | N/A | N/A | 10720 | 10735 | GAGGTGGAATCCCACA | 83 | 3232 |
| 1155136 | N/A | N/A | 11571 | 11586 | AGCTGGAGTCCAGAGT | 45 | 3233 |
| 1155142 | N/A | N/A | 11839 | 11854 | TTGCACCACTTCTGCC | 83 | 3234 |

TABLE 46-continued

Inhibition of Foxp3 mRNA by 3-10-3 cEt gapmers targeting SEQ ID NO.: 1, and 2

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | FOXP3 (% UTC) | SEQ ID NO |
|---|---|---|---|---|---|---|---|
| 1155148 | N/A | N/A | 12397 | 12412 | GCTATTTTATGGGTCC | 19 | 3235 |
| 1155154 | N/A | N/A | 12574 | 12589 | AATGGGTGTTACAAGG | 57 | 3236 |
| 1155160 | N/A | N/A | 12705 | 12720 | GGAATATCTGGTATCA | 70 | 3237 |
| 1155166 | N/A | N/A | 12886 | 12901 | GTGGTTAGGCTCAGGG | 51 | 3238 |
| 1155171 | N/A | N/A | 12930 | 12945 | TGGTTTGAATTATCGA | 37 | 3239 |
| 1155177 | N/A | N/A | 13345 | 13360 | GGCAGGTAATCAGGGA | 51 | 3240 |

TABLE 47

Inhibition of Foxp3 mRNA by 3-10-3 cEt gapmers targeting SEQ ID NO.:3, 4 and 5

| Compound Number | SEQ ID NO: 3 Start Site | SEQ ID NO: 3 Stop Site | SEQ ID NO: 4 Start Site | SEQ ID NO: 4 Stop Site | SEQ ID NO: 5 Start Site | SEQ ID NO: 5 Stop Site | Sequence (5' to 3') | FOXP3 (% UTC) | SEQ ID NO |
|---|---|---|---|---|---|---|---|---|---|
| 1062517 | N/A | N/A | N/A | N/A | 11 | 26 | GGCGAGGCTCCTGAGA | 92 | 626 |
| 911066 | 395 | 410 | N/A | N/A | 162 | 177 | CACCGTTGAGAGCTGC | 54 | 3241 |
| 1062518 | N/A | N/A | N/A | N/A | 12 | 27 | GGGCGAGGCTCTGAG | 75 | 3242 |
| 1063075 | N/A | N/A | 11215 | 11230 | N/A | N/A | TAAACTGAGGCCTGCA | 74 | 3243 |
| 1062451 | 393 | 408 | N/A | N/A | 160 | 175 | CCGTTGAGAGCTGCAG | 53 | 3244 |
| 1062452 | 394 | 409 | N/A | N/A | 161 | 176 | ACCGTTGAGAGCTGCA | 82 | 3245 |
| 1062519 | N/A | N/A | N/A | N/A | 13 | 28 | TGGGCGAGGCTCCTGA | 98 | 3246 |

Example 3: Dose-Dependent Inhibition of Human Foxp3 in LNCaP Cells by cEt Gapmers Modified oligonucleotides described in the studies above were tested at various doses in LNCaP cells. Cultured LNCaP cells at a density of 30,000 cells per well were transfected using electroporation with modified oligonucleotides diluted to concentrations of 8,000 nM, 4,000 nM, 500 nM and 125 nM for 24 hours. After 24 hours, Foxp3 mRNA levels were measured as previously described using the Human Foxp3 primer-probe set RTS35925. Foxp3 mRNA levels were adjusted according to total RNA content, as measured by RIBOGREEN®. Results are presented in the tables below as percent control of the amount of Foxp3 mRNA relative to untreated control cells (% UTC). IC50s were calculated using a linear regression on a log/linear plot of the data in excel.

TABLE 48

Dose-dependent inhibition of human Foxp3 mRNA expression by modified oligonucleotides in LNCaP cells

| | % UTC | | | | |
|---|---|---|---|---|---|
| ION NO. | 125 nM | 500 nM | 2000 nM | 8000 nM | IC$_{50}$ (µM) |
| 911180 | 87 | 45 | 15 | 2 | 0.5 |
| 911032 | 74 | 63 | 28 | 9 | 0.7 |
| 910969 | 91 | 75 | 24 | 11 | 0.9 |
| 911120 | 73 | 57 | 19 | 15 | 0.5 |
| 911152 | 99 | 70 | 29 | 15 | 0.9 |
| 910965 | 112 | 70 | 34 | 22 | 1.1 |
| 911144 | 56 | 47 | 23 | 8 | 0.3 |
| 911028 | 99 | 67 | 36 | 22 | 1.1 |
| 911012 | 85 | 53 | 17 | 5 | 0.5 |
| 910926 | 75 | 58 | 32 | 14 | 0.7 |
| 910958 | 98 | 66 | 35 | 18 | 1.0 |

TABLE 48-continued

Dose-dependent inhibition of human Foxp3 mRNA expression by modified oligonucleotides in LNCaP cells

| ION NO. | 125 nM | 500 nM | 2000 nM | 8000 nM | IC$_{50}$ (µM) |
|---|---|---|---|---|---|
| 911093 | 83 | 76 | 33 | 16 | 1.1 |
| 911105 | 100 | 72 | 39 | 16 | 1.3 |
| 911133 | 75 | 41 | 27 | 10 | 0.4 |
| 911101 | 100 | 48 | 26 | 16 | 0.7 |
| 910930 | 89 | 58 | 25 | 4 | 0.7 |
| 910962 | 90 | 47 | 35 | 24 | 0.7 |
| 910997 | 105 | 52 | 27 | 19 | 0.7 |
| 911110 | 101 | 54 | 23 | 10 | 0.7 |

TABLE 49

Dose-dependent inhibition of human Foxp3 mRNA expression by modified oligonucleotides in LNCaP cells

| ION NO. | 125 nM | 500 nM | 2000 nM | 8000 nM | IC$_{50}$ (µM) |
|---|---|---|---|---|---|
| 911098 | 80 | 53 | 24 | 8 | 0.6 |
| 911118 | 73 | 53 | 28 | 3 | 0.5 |
| 911014 | 104 | 53 | 26 | 16 | 0.7 |
| 911162 | 94 | 66 | 17 | 11 | 0.7 |
| 911182 | 103 | 70 | 27 | 10 | 0.9 |
| 910959 | 94 | 52 | 20 | 9 | 0.6 |
| 910955 | 59 | 64 | 39 | 13 | 0.9 |
| 911194 | 79 | 44 | 19 | 5 | 0.4 |
| 911023 | 92 | 69 | 30 | 14 | 0.9 |
| 910956 | 74 | 47 | 19 | 6 | 0.4 |
| 911179 | 106 | 55 | 21 | 8 | 0.7 |
| 911171 | 76 | 59 | 21 | 11 | 0.6 |
| 911011 | 116 | 58 | 30 | 11 | 0.9 |
| 910924 | 88 | 66 | 30 | 12 | 0.9 |
| 911019 | 76 | 52 | 24 | 6 | 0.5 |
| 911051 | 99 | 75 | 33 | 14 | 1.1 |
| 910980 | 67 | 41 | 33 | 10 | 0.4 |
| 911183 | 113 | 75 | 43 | 23 | 1.5 |
| 911180 | 105 | 46 | 30 | 7 | 0.7 |

Example 4: Dose-Dependent Inhibition of Human Foxp3 in SUP-M2 Cells by cEt Gapmers Modified oligonucleotides described in the studies above were tested at various doses in SUP-M2 cells. ION No. 141923 (5-10-5 MOE gapmer, CCTTCCCT-GAAGGTTCCTCC, designated herein as SEQ ID NO: 3247), a control modified oligonucleotide that does not target Foxp3, has been included in each experiment as a negative control.

Cultured SUP-M2 cells at a density of 60,000 cells per well were treated using free uptake with modified oligonucleotides diluted to concentrations of 7,000 nM, 1,750 nM, 437.5 nM and 109.375 nM for 24 hours. After 24 hours, Foxp3 mRNA levels were measured as previously described using the Human Foxp3 primer-probe set RTS35925. Foxp3 mRNA levels were adjusted according to total RNA content, as measured by RIBOGREEN®. Results are presented in the tables below as percent control of the amount of Foxp3 mRNA relative to untreated control cells (% UTC). IC50s were calculated using a linear regression on a log/linear plot of the data in excel. The modified oligonucleotides with percent control values marked with an asterisk (*) target the amplicon region of the primer probe set. Additional assays may be used to measure the potency and efficacy of the modified oligonucleotides targeting the amplicon region.

TABLE 50

Dose-dependent inhibition of human Foxp3 mRNA expression by free uptake of modified oligonucleotides in SUP-M2 cells

| ION No. | 109.375 nM | 437.5 nM | 1750.0 nM | 7000.0 nM | IC$_{50}$ (µM) |
|---|---|---|---|---|---|
| 910956 | 82 | 73 | 39 | 26 | 1.2 |
| 911144 | 74 | 81 | 47 | 11 | 1.1 |
| 911179 | 75 | 44 | 19 | 10 | 0.4 |
| 1062005 | 121 | 75 | 19 | 6 | 1.1 |
| 1062006 | 97 | 65 | 41 | 15 | 1.1 |
| 1062166 | 99 | 127 | 109 | 94 | >7.0 |
| 1062422 | 114 | 104 | 75 | 51 | >7.0 |
| 1062645 | 148 | 93 | 49 | 17 | 2.0 |
| 1062838 | 137 | 88 | 28 | 11 | 1.4 |
| 1062839 | 72 | 82 | 54 | 20 | 1.5 |
| 1062903 | 108 | 47 | 9 | 7 | 0.7 |
| 1063062 | 123 | 78 | 36 | 18 | 1.5 |
| 1063063 | 98 | 63 | 21 | 14 | 0.8 |
| 1063094 | 150 | 126 | 78 | 60 | >7.0 |
| 1063158 | 138 | 97 | 66 | 43 | 4.3 |
| 1063159 | 71 | 90 | 66 | 23 | 2.4 |
| 1063542 | 103 | 107 | 101 | 88 | >7.0 |
| 1063734 | 73 | 45 | 11 | 5 | 0.3 |
| 1063988 | 130 | 119 | 60 | 26 | 3.1 |

TABLE 51

Dose-dependent inhibition of human Foxp3 mRNA expression by free uptake of modified oligonucleotides in SUP-M2 cells

| ION No. | 109.375 nM | 437.5 nM | 1750.0 nM | 7000.0 nM | IC$_{50}$ (µM) |
|---|---|---|---|---|---|
| 911144 | 112 | 68 | 42 | 12 | 1.3 |
| 1062008 | 69 | 30 | 10 | 3 | 0.2 |
| 1062009 | 80 | 40 | 18 | 5 | 0.4 |
| 1062393 | 71 | 42 | 42 | 14 | 0.5 |
| 1062425 | 58 | 23 | 5 | 2 | <0.1 |
| 1062937 | 75 | 44 | 37 | 18 | 0.5 |
| 1062938 | 62 | 41 | 21 | 5 | 0.2 |
| 1063033 | 64 | 48 | 24 | 15 | 0.3 |
| 1063097 | 79 | 43 | 23 | 12 | 0.5 |
| 1063320 | 67 | 46 | 22 | 14 | 0.3 |
| 1063353 | 81 | 52 | 54 | 52 | >7.0 |
| 1063736 | 83 | 60 | 41 | 15 | 0.9 |
| 1063768 | 65 | 64 | 20 | 19 | 0.5 |
| 1063769 | 66 | 24 | 5 | 1 | 0.2 |
| 1063895 | 74 | 44 | 34 | 11 | 0.5 |
| 1063959 | 114 | 93 | 49 | 23 | 2.1 |
| 1063960 | 73 | 35 | 19 | 9 | 0.3 |
| 1064121 | 78 | 51 | 34 | 14 | 0.6 |
| 1064122 | 82 | 61 | 41 | 13 | 0.8 |

TABLE 52

Dose-dependent inhibition of human Foxp3 mRNA expression by free uptake of modified oligonucleotides in SUP-M2 cells

| ION No. | 109.375 nM | 437.5 nM | 1750.0 nM | 7000.0 nM | IC$_{50}$ (µM) |
|---|---|---|---|---|---|
| 911144 | 44 | 43 | 36 | 11 | <0.1 |
| 1062010 | 64 | 28 | 10 | 3 | 0.2 |
| 1062268 | 13* | 19* | 9* | 3* | <0.1* |
| 1062299 | 112 | 140 | 148 | 103 | >7.0 |

TABLE 52-continued

Dose-dependent inhibition of human Foxp3 mRNA expression by free uptake of modified oligonucleotides in SUP-M2 cells

| | % UTC | | | | |
|---|---|---|---|---|---|
| ION No. | 109.375 nM | 437.5 nM | 1750.0 nM | 7000.0 nM | $IC_{50}$ (μM) |
| 1062331 | 138 | 93 | 113 | 59 | >7.0 |
| 1062395 | 80 | 41 | 16 | 4 | 0.4 |
| 1062426 | 101 | 57 | 27 | 13 | 0.8 |
| 1062427 | 139 | 133 | 54 | 13 | 2.5 |
| 1062907 | 103 | 57 | 17 | 6 | 0.7 |
| 1062908 | 142 | 75 | 43 | 13 | 1.6 |
| 1063035 | 86 | 50 | 27 | 9 | 0.6 |
| 1063036 | 160 | 102 | 46 | 8 | 1.9 |
| 1063037 | 40 | 27 | 35 | 19 | <0.1 |
| 1063067 | 118 | 84 | 37 | 21 | 1.6 |
| 1063099 | 70 | 67 | 49 | 23 | 1.1 |
| 1063163 | 117 | 62 | 35 | 13 | 1.2 |
| 1063164 | 129 | 112 | 68 | 25 | 3.2 |
| 1063962 | 153 | 129 | 69 | 33 | 4.0 |
| 1064091 | 36 | 37 | 51 | 27 | <0.1 |

TABLE 53

Dose-dependent inhibition of human Foxp3 mRNA expression by free uptake of modified oligonucleotides in SUP-M2 cells

| | % UTC | | | | |
|---|---|---|---|---|---|
| ION No. | 109.375 nM | 437.5 nM | 1750.0 nM | 7000.0 nM | $IC_{50}$ (μM) |
| 911144 | 61 | 48 | 29 | 12 | 0.3 |
| 1062007 | 102 | 35 | 25 | 6 | 0.6 |
| 1062044 | 53 | 37 | 21 | 13 | 0.1 |
| 1062263 | 113* | 72* | 30* | 6* | 1.1* |
| 1062396 | 47 | 44 | 34 | 23 | <0.1 |
| 1062428 | 59 | 37 | 19 | 14 | 0.2 |
| 1062712 | 67 | 78 | 42 | 18 | 0.9 |
| 1062840 | 102 | 41 | 37 | 7 | 0.7 |
| 1062904 | 60 | 86 | 32 | 26 | 0.9 |
| 1062909 | 47 | 44 | 22 | 13 | <0.1 |
| 1063032 | 85 | 41 | 11 | 3 | 0.4 |
| 1063101 | 49 | 35 | 22 | 8 | <0.1 |
| 1063197 | 51 | 47 | 31 | 14 | 0.2 |
| 1063319 | 47 | 42 | 62 | 54 | 0.6 |
| 1063324 | 86 | 43 | 26 | 13 | 0.6 |
| 1063511 | 89 | 53 | 50 | 14 | 0.9 |
| 1063735 | 86 | 27 | 34 | 12 | 0.4 |
| 1063963 | 49 | 33 | 18 | 7 | <0.1 |
| 1064312 | 56 | 42 | 50 | 33 | 0.3 |

TABLE 54

Dose-dependent inhibition of human Foxp3 mRNA expression by free uptake of modified oligonucleotides in SUP-M2 cells

| | % UTC | | | | |
|---|---|---|---|---|---|
| ION No. | 109.375 nM | 437.5 nM | 1750.0 nM | 7000.0 nM | $IC_{50}$ (μM) |
| 911144 | 80 | 51 | 41 | 14 | 0.7 |
| 1062015 | 76 | 66 | 41 | 39 | 1.6 |
| 1062047 | 86 | 68 | 46 | 16 | 1.1 |
| 1062206 | 88 | 87 | 92 | 87 | >7.0 |
| 1062335 | 86 | 68 | 63 | 28 | 2.1 |
| 1062336 | 91 | 73 | 36 | 18 | 1.1 |
| 1062367 | 90 | 61 | 36 | 11 | 0.9 |
| 1062368 | 68 | 29 | 9 | 7 | 0.2 |
| 1062431 | 66 | 54 | 45 | 30 | 0.7 |
| 1062560 | 97 | 63 | 40 | 21 | 1.2 |
| 1062753 | 77 | 71 | 41 | 39 | 1.7 |

TABLE 54-continued

Dose-dependent inhibition of human Foxp3 mRNA expression by free uptake of modified oligonucleotides in SUP-M2 cells

| | % UTC | | | | |
|---|---|---|---|---|---|
| ION No. | 109.375 nM | 437.5 nM | 1750.0 nM | 7000.0 nM | $IC_{50}$ (μM) |
| 1063648 | 115 | 69 | 29 | 11 | 1.1 |
| 1063649 | 71 | 35 | 14 | 1 | 0.3 |
| 1063743 | 110 | 81 | 43 | 17 | 1.5 |
| 1063744 | 82 | 47 | 10 | 4 | 0.4 |
| 1063967 | 90 | 90 | 88 | 80 | >7.0 |
| 1064094 | 71 | 59 | 37 | 21 | 0.7 |
| 1064095 | 94 | 78 | 40 | 12 | 1.2 |
| 1064161 | 80 | 71 | 67 | 36 | 3.4 |

TABLE 55

Dose-dependent inhibition of human Foxp3 mRNA expression by free uptake of modified oligonucleotides in SUP-M2 cells

| | % UTC | | | | |
|---|---|---|---|---|---|
| ION No. | 109.375 nM | 437.5 nM | 1750.0 nM | 7000.0 nM | $IC_{50}$ (μM) |
| 911144 | 39 | 22 | 21 | 7 | <0.1 |
| 1062372 | 83 | 51 | 23 | 11 | 0.6 |
| 1062596 | 44 | 44 | 63 | 42 | 4.3 |
| 1062660 | 43 | 31 | 62 | 58 | 1.1 |
| 1062724 | 51 | 19 | 7 | 2 | <0.1 |
| 1062725 | 101 | 80 | 31 | 14 | 1.2 |
| 1062885 | 93 | 41 | 48 | 15 | 0.8 |
| 1062979 | 116 | 39 | 25 | 14 | 0.8 |
| 1063203 | 95 | 54 | 25 | 20 | 0.8 |
| 1063234 | 71 | 78 | 27 | 17 | 0.8 |
| 1063268 | 55 | 36 | 22 | 7 | 0.1 |
| 1063331 | 52 | 23 | 10 | 3 | <0.1 |
| 1063332 | 104 | 75 | 34 | 16 | 1.2 |
| 1063394 | 86 | 69 | 38 | 22 | 1.1 |
| 1063491 | 49 | 18 | 9 | 4 | <0.1 |
| 1063587 | 88 | 87 | 59 | 40 | 3.9 |
| 1063619 | 39 | 20 | 17 | 9 | <0.1 |
| 1063651 | 101 | 71 | 38 | 18 | 1.2 |
| 1063652 | 75 | 61 | 25 | 12 | 0.6 |

TABLE 56

Dose-dependent inhibition of human Foxp3 mRNA expression by free uptake of modified oligonucleotides in SUP-M2 cells

| | % UTC | | | | |
|---|---|---|---|---|---|
| ION No. | 109.375 nM | 437.5 nM | 1750.0 nM | 7000.0 nM | $IC_{50}$ (μM) |
| 911144 | 81 | 54 | 35 | 9 | 0.6 |
| 1062087 | 51 | 30 | 23 | 8 | <0.1 |
| 1062247 | 66 | 52 | 27 | 21 | 0.4 |
| 1062375 | 51 | 26 | 14 | 5 | <0.1 |
| 1062376 | 102 | 67 | 39 | 15 | 1.1 |
| 1062439 | 103 | 48 | 26 | 18 | 0.8 |
| 1062504 | 188 | 173 | 105 | 57 | >7.0 |
| 1062536 | 100 | 97 | 81 | 19 | 3.2 |
| 1062760 | 59 | 29 | 17 | 18 | 0.1 |
| 1062761 | 136 | 103 | 39 | 49 | 3.4 |
| 1062857 | 57 | 65 | 37 | 24 | 0.6 |
| 1063049 | 134 | 117 | 57 | 24 | 2.8 |
| 1063145 | 141 | 103 | 28 | 21 | 1.8 |
| 1063399 | 93 | 109 | 33 | 21 | 1.7 |
| 1063400 | 106 | 54 | 77 | 22 | 2.1 |
| 1063912 | 75 | 48 | 40 | 26 | 0.7 |

TABLE 56-continued

Dose-dependent inhibition of human Foxp3 mRNA expression by free uptake of modified oligonucleotides in SUP-M2 cells

| ION No. | 109.375 nM | 437.5 nM | 1750.0 nM | 7000.0 nM | IC$_{50}$ (µM) |
|---|---|---|---|---|---|
| | | % UTC | | | |
| 1063975 | 110 | 100 | 39 | 18 | 1.7 |
| 1063976 | 51 | 33 | 16 | 6 | <0.1 |
| 1064103 | 72 | 48 | 24 | 22 | 0.4 |

TABLE 57

Dose-dependent inhibition of human Foxp3 mRNA expression by free uptake of modified oligonucleotides in SUP-M2 cells

| ION No. | 109.375 nM | 437.5 nM | 1750.0 nM | 7000.0 nM | IC$_{50}$ (µM) |
|---|---|---|---|---|---|
| | | % UTC | | | |
| 911144 | 86 | 55 | 26 | 8 | 0.6 |
| 1062030 | 110 | 45 | 12 | 3 | 0.7 |
| 1062125 | 156 | 149 | 93 | 67 | >7.0 |
| 1062349 | 154 | 91 | 41 | 21 | 2.0 |
| 1062382 | 72 | 57 | 20 | 10 | 0.5 |
| 1062446 | 120 | 106 | 100 | 48 | >7.0 |
| 1062542 | 94 | 98 | 79 | 28 | 4.3 |
| 1062670 | 115 | 68 | 42 | 45 | 2.5 |
| 1062991 | 108 | 41 | 40 | 18 | 1.0 |
| 1063055 | 98 | 83 | 57 | 39 | 3.3 |
| 1063310 | 116 | 100 | 51 | 25 | 2.4 |
| 1063437 | 188 | 147 | 88 | 85 | >7.0 |
| 1063757 | 121 | 114 | 62 | 74 | >7.0 |
| 1063917 | 109 | 87 | 30 | 20 | 1.4 |
| 1063948 | 111 | 97 | 36 | 11 | 1.5 |
| 1063981 | 122 | 57 | 22 | 4 | 0.9 |
| 1064012 | 184 | 159 | 122 | 82 | >7.0 |
| 1064111 | 115 | 140 | 86 | 52 | >7.0 |
| 1064303 | 114 | 98 | 74 | 48 | >7.0 |

TABLE 58

Dose-dependent inhibition of human Foxp3 mRNA expression by free uptake of modified oligonucleotides in SUP-M2 cells

| ION No. | 109.375 nM | 437.5 nM | 1750.0 nM | 7000.0 nM | IC$_{50}$ (µM) |
|---|---|---|---|---|---|
| | | % UTC | | | |
| 911144 | 114 | 70 | 22 | 9 | 1.0 |
| 1062094 | 36 | 71 | 65 | 50 | <0.1 |
| 1062383 | 76 | 71 | 54 | 23 | 1.4 |
| 1062384 | 57 | 45 | 23 | 9 | 0.2 |
| 1062447 | 85 | 96 | 62 | 35 | 3.8 |
| 1062448 | 99 | 91 | 33 | 15 | 1.4 |
| 1062543 | 64 | 57 | 23 | 9 | 0.4 |
| 1062737 | 93 | 56 | 24 | 11 | 0.7 |
| 1062802 | 92 | 48 | 21 | 8 | 0.6 |
| 1062832 | 79 | 84 | 43 | 11 | 1.1 |
| 1062833 | 93 | 75 | 30 | 12 | 1.0 |
| 1063058 | 82 | 35 | 25 | 5 | 0.4 |
| 1063247 | 70 | 55 | 40 | 11 | 0.6 |
| 1063248 | 59 | 39 | 26 | 5 | 0.2 |
| 1063822 | 78 | 77 | 80 | 57 | >7.0 |
| 1063982 | 90 | 81 | 37 | 16 | 1.2 |
| 1064047 | 112 | 86 | 51 | 20 | 1.9 |
| 1064113 | 57 | 74 | 31 | 15 | 0.5 |
| 1064145 | 100 | 73 | 43 | 13 | 1.2 |

TABLE 59

Dose-dependent inhibition of human Foxp3 mRNA expression by free uptake of modified oligonucleotides in SUP-M2 cells

| ION No. | 109.375 nM | 437.5 nM | 1750.0 nM | 7000.0 nM | IC$_{50}$ (µM) |
|---|---|---|---|---|---|
| | | % UTC | | | |
| 911144 | 76 | 69 | 34 | 14 | 0.8 |
| 1062035 | 91 | 57 | 32 | 18 | 0.9 |
| 1062067 | 71 | 36 | 15 | 9 | 0.3 |
| 1062100 | 120 | 132 | 106 | 69 | >7.0 |
| 1062132 | 109 | 68 | 83 | 68 | >7.0 |
| 1062580 | 96 | 35 | 9 | 0 | 0.5 |
| 1062644 | 140 | 77 | 35 | 5 | 1.4 |
| 1062741 | 109 | 71 | 35 | 11 | 1.2 |
| 1062837 | 128 | 65 | 41 | 14 | 1.4 |
| 1062933 | 109 | 75 | 46 | 26 | 1.8 |
| 1063348 | 97 | 86 | 41 | 15 | 1.4 |
| 1063410 | 86 | 88 | 58 | 49 | 6.3 |
| 1063699 | 89 | 66 | 44 | 15 | 1.0 |
| 1063731 | 70 | 27 | 8 | 3 | 0.2 |
| 1063732 | 75 | 45 | 29 | 7 | 0.4 |
| 1063794 | 88 | 116 | 122 | 93 | >7.0 |
| 1063954 | 90 | 64 | 19 | 4 | 0.7 |
| 1064019 | 74 | 73 | 45 | 31 | 1.4 |
| 1064148 | 102 | 54 | 31 | 15 | 0.9 |

TABLE 60

Dose-dependent inhibition of human Foxp3 mRNA expression by free uptake of modified oligonucleotides in SUP-M2 cells

| ION No. | 109.375 nM | 437.5 nM | 1750.0 nM | 7000.0 nM | IC$_{50}$ (µM) |
|---|---|---|---|---|---|
| | | % UTC | | | |
| 911144 | 88 | 71 | 29 | 11 | 0.9 |
| 1062078 | 123 | 118 | 110 | 88 | >7.0 |
| 1062334 | 93 | 68 | 40 | 12 | 1.0 |
| 1062365 | 60 | 26 | 9 | 2 | 0.1 |
| 1062366 | 98 | 60 | 22 | 6 | 0.7 |
| 1062397 | 70 | 46 | 25 | 9 | 0.4 |
| 1062783 | 83 | 72 | 34 | 13 | 0.9 |
| 1063038 | 77 | 34 | 17 | 5 | 0.3 |
| 1063039 | 96 | 76 | 55 | 35 | 2.6 |
| 1063326 | 114 | 89 | 48 | 21 | 1.9 |
| 1063646 | 93 | 75 | 59 | 39 | 3.2 |
| 1063774 | 87 | 86 | 61 | 37 | 3.6 |
| 1063804 | 79 | 58 | 37 | 15 | 0.7 |
| 1063901 | 125 | 92 | 81 | 55 | >7.0 |
| 1063964 | 83 | 92 | 49 | 21 | 1.8 |
| 1064060 | 117 | 85 | 55 | 35 | 2.8 |
| 1064120 | 85 | 85 | 58 | 46 | 5.0 |
| 1064184 | 96 | 72 | 33 | 19 | 1.1 |
| 1064191 | 85 | 79 | 52 | 20 | 1.5 |

TABLE 61

Dose-dependent inhibition of human Foxp3 mRNA expression by free uptake of modified oligonucleotides in SUP-M2 cells

| ION No. | 109.375 nM | 437.5 nM | 1750.0 nM | 7000.0 nM | IC$_{50}$ (µM) |
|---|---|---|---|---|---|
| | | % UTC | | | |
| 911144 | 100 | 62 | 25 | 5 | 0.8 |
| 1062017 | 96 | 82 | 48 | 27 | 1.9 |
| 1062305 | 67 | 57 | 36 | 16 | 0.5 |
| 1062369 | 92 | 52 | 29 | 10 | 0.7 |
| 1062529 | 33 | 14 | 13 | 9 | <0.1 |

TABLE 61-continued

Dose-dependent inhibition of human Foxp3 mRNA expression by free uptake of modified oligonucleotides in SUP-M2 cells

| ION No. | % UTC 109.375 nM | 437.5 nM | 1750.0 nM | 7000.0 nM | $IC_{50}$ (μM) |
|---|---|---|---|---|---|
| 1062561 | 98 | 85 | 71 | 37 | 4.4 |
| 1062562 | 139 | 94 | 45 | 22 | 2.1 |
| 1062722 | 90 | 60 | 29 | 8 | 0.7 |
| 1062723 | 104 | 103 | 48 | 16 | 1.9 |
| 1062754 | 88 | 78 | 77 | 38 | 5.5 |
| 1063074 | 83 | 74 | 60 | 22 | 1.8 |
| 1063329 | 77 | 31 | 12 | 4 | 0.3 |
| 1063330 | 60 | 37 | 15 | 4 | 0.2 |
| 1063553 | 75 | 64 | 39 | 19 | 0.8 |
| 1063650 | 119 | 40 | 10 | 2 | 0.7 |
| 1063745 | 73 | 46 | 14 | 3 | 0.4 |
| 1063905 | 109 | 89 | 31 | 6 | 1.2 |
| 1064064 | 75 | 79 | 35 | 21 | 1.0 |
| 1064096 | 65 | 35 | 9 | 3 | 0.2 |

TABLE 62

Dose-dependent inhibition of human Foxp3 mRNA expression by free uptake of modified oligonucleotides in SUP-M2 cells

| ION No. | % UTC 109.375 nM | 437.5 nM | 1750.0 nM | 7000.0 nM | $IC_{50}$ (μM) |
|---|---|---|---|---|---|
| 911144 | 108 | 91 | 31 | 12 | 1.3 |
| 1062021 | 60 | 47 | 29 | 12 | 0.3 |
| 1062086 | 64 | 40 | 20 | 11 | 0.2 |
| 1062310 | 84 | 54 | 24 | 11 | 0.6 |
| 1062373 | 52 | 37 | 4 | 2 | 0.1 |
| 1062407 | 93 | 52 | 25 | 13 | 0.7 |
| 1062437 | 89 | 64 | 48 | 18 | 1.2 |
| 1062470 | 93 | 78 | 37 | 2 | 1.0 |
| 1062566 | 86 | 58 | 22 | 7 | 0.6 |
| 1062823 | 114 | 98 | 76 | 35 | 4.6 |
| 1063207 | 83 | 77 | 32 | 6 | 0.9 |
| 1063237 | 32 | 22 | 18 | 11 | <0.1 |
| 1063238 | 33 | 25 | 16 | 9 | <0.1 |
| 1063333 | 71 | 44 | 23 | 10 | 0.4 |
| 1063429 | 78 | 63 | 48 | 28 | 1.2 |
| 1063653 | 79 | 36 | 15 | 4 | 0.3 |
| 1063654 | 88 | 61 | 60 | 12 | 1.2 |
| 1063655 | 99 | 60 | 29 | 8 | 0.8 |
| 1063910 | 93 | 57 | 18 | 6 | 0.6 |

TABLE 63

Dose-dependent inhibition of human Foxp3 mRNA expression by free uptake of modified oligonucleotides in SUP-M2 cells

| ION No. | % UTC 109.375 nM | 437.5 nM | 1750.0 nM | 7000.0 nM | $IC_{50}$ (μM) |
|---|---|---|---|---|---|
| 911144 | 100 | 80 | 29 | 7 | 1.0 |
| 1062377 | 95 | 101 | 51 | 23 | 2.2 |
| 1062378 | 65 | 45 | 24 | 6 | 0.3 |
| 1062410 | 117 | 80 | 50 | 53 | 4.1 |
| 1062441 | 90 | 71 | 60 | 48 | 5.2 |
| 1062570 | 79 | 50 | 26 | 9 | 0.5 |
| 1062633 | 104 | 77 | 67 | 42 | 4.2 |
| 1062699 | 106 | 70 | 37 | 19 | 1.3 |
| 1062890 | 81 | 64 | 47 | 30 | 1.4 |

TABLE 63-continued

Dose-dependent inhibition of human Foxp3 mRNA expression by free uptake of modified oligonucleotides in SUP-M2 cells

| ION No. | % UTC 109.375 nM | 437.5 nM | 1750.0 nM | 7000.0 nM | $IC_{50}$ (μM) |
|---|---|---|---|---|---|
| 1062891 | 68 | 35 | 15 | 6 | 0.2 |
| 1063082 | 83 | 101 | 73 | 63 | >7.0 |
| 1063146 | 89 | 77 | 50 | 52 | 4.7 |
| 1063178 | 79 | 71 | 43 | 15 | 1.0 |
| 1063529 | 98 | 90 | 76 | 50 | >7.0 |
| 1063658 | 96 | 61 | 30 | 12 | 0.9 |
| 1063721 | 74 | 77 | 53 | 28 | 1.7 |
| 1063946 | 91 | 37 | 10 | 3 | 0.4 |
| 1064008 | 84 | 68 | 34 | 18 | 0.9 |
| 1064203 | 97 | 85 | 37 | 21 | 1.5 |

TABLE 64

Dose-dependent inhibition of human Foxp3 mRNA expression by free uptake of modified oligonucleotides in SUP-M2 cells

| ION No. | % UTC 109.375 nM | 437.5 nM | 1750.0 nM | 7000.0 nM | $IC_{50}$ (μM) |
|---|---|---|---|---|---|
| 911144 | 94 | 53 | 24 | 5 | 0.7 |
| 1062028 | 34 | 26 | 3 | 1 | <0.1 |
| 1062029 | 46 | 26 | 3 | 0 | <0.1 |
| 1062347 | 95 | 137 | 107 | 82 | >7.0 |
| 1062348 | 66 | 51 | 35 | 13 | 0.4 |
| 1062379 | 88 | 56 | 23 | 6 | 0.6 |
| 1062413 | 74 | 24 | 19 | 4 | 0.2 |
| 1062667 | 76 | 65 | 24 | 8 | 0.6 |
| 1062668 | 93 | 29 | 11 | 3 | 0.4 |
| 1062669 | 81 | 45 | 14 | 3 | 0.4 |
| 1062700 | 69 | 50 | 32 | 12 | 0.5 |
| 1062861 | 76 | 77 | 44 | 31 | 1.6 |
| 1062894 | 94 | 57 | 31 | 11 | 0.8 |
| 1062989 | 82 | 44 | 11 | 3 | 0.4 |
| 1063054 | 106 | 90 | 55 | 15 | 1.8 |
| 1063818 | 110 | 112 | 99 | 109 | >7.0 |
| 1063915 | 94 | 73 | 33 | 10 | 1.0 |
| 1063947 | 66 | 36 | 5 | 3 | 0.2 |
| 1063980 | 71 | 35 | 9 | 1 | 0.3 |

TABLE 65

Dose-dependent inhibition of human Foxp3 mRNA expression by free uptake of modified oligonucleotides in SUP-M2 cells

| ION No. | % UTC 109.375 nM | 437.5 nM | 1750.0 nM | 7000.0 nM | $IC_{50}$ (μM) |
|---|---|---|---|---|---|
| 911144 | 98 | 58 | 12 | 22 | 0.8 |
| 1062034 | 75 | 56 | 20 | 8 | 0.5 |
| 1062322 | 107 | 73 | 29 | 13 | 1.1 |
| 1062385 | 93 | 56 | 18 | 5 | 0.6 |
| 1062386 | 74 | 51 | 22 | 14 | 0.5 |
| 1062481 | 56 | 67 | 42 | 27 | 0.7 |
| 1062545 | 99 | 90 | 49 | 14 | 1.6 |
| 1062641 | 96 | 59 | 27 | 7 | 0.8 |
| 1062739 | 92 | 59 | 28 | 7 | 0.7 |
| 1062771 | 73 | 57 | 27 | 6 | 0.5 |
| 1062803 | 92 | 59 | 33 | 16 | 0.9 |
| 1062834 | 117 | 55 | 14 | 7 | 0.8 |
| 1062835 | 80 | 53 | 18 | 12 | 0.5 |

TABLE 65-continued

Dose-dependent inhibition of human Foxp3 mRNA
expression by free uptake of modified oligonucleotides in
SUP-M2 cells

| ION No. | 109.375 nM | 437.5 nM | 1750.0 nM | 7000.0 nM | $IC_{50}$ (µM) |
|---|---|---|---|---|---|
| | | % UTC | | | |
| 1063314 | 141 | 56 | 18 | 5 | 1.0 |
| 1063538 | 38 | 29 | 15 | 5 | <0.1 |
| 1063921 | 77 | 41 | 19 | 5 | 0.4 |
| 1063984 | 78 | 35 | 21 | 5 | 0.3 |
| 1064017 | 96 | 61 | 31 | 12 | 0.9 |
| 1064147 | 99 | 74 | 38 | 11 | 1.1 |

Example 5: Dose-Dependent Inhibition of Human Foxp3 in SUP-M2 Cells by cEt Gapmers Modified oligonucleotides described in the studies above were tested at various doses in SUP-M2 cells. Cultured SUP-M2 cells at a density of 60,000 cells per well were treated using free uptake with modified oligonucleotides diluted to concentrations of 6,000 nM, 1,500 nM, 375.0 nM and 93.75 nM for 24 hours. After 24 hours, Foxp3 mRNA levels were measured as previously described using the Human Foxp3 primer-probe set RTS35925. Foxp3 mRNA levels were adjusted according to total RNA content, as measured by RIBOGREEN®. Results are presented in the tables below as percent control of the amount of Foxp3 mRNA relative to untreated control cells (% UTC). IC50s were calculated using a linear regression on a log/linear plot of the data in excel. The modified oligonucleotides with percent control values marked with an asterisk (*) target the amplicon region of the primer probe set. Additional assays may be used to measure the potency and efficacy of the modified oligonucleotides targeting the amplicon region.

TABLE 66

Dose-dependent inhibition of human Foxp3 mRNA
expression by free uptake of modified oligonucleotides in
SUP-M2 cells

| ION No. | 93.75 nM | 375.0 nM | 1500.0 nM | 6000.0 nM | $IC_{50}$ (µM) |
|---|---|---|---|---|---|
| | | % UTC | | | |
| 911144 | 69 | 81 | 61 | 30 | 2.1 |
| 1154721 | 149 | 89 | 49 | 18 | 1.7 |
| 1154747 | 198 | 140 | 106 | 39 | 5.1 |
| 1154751 | 170 | 107 | 60 | 32 | 2.7 |
| 1154754 | 77 | 91 | 81 | 46 | >6.0 |
| 1154765 | 151 | 98 | 88 | 33 | 3.8 |
| 1154853 | 205 | 149 | 57 | 23 | 2.7 |
| 1154861 | 81 | 86 | 69 | 40 | 5.0 |
| 1154865 | 143 | 77 | 44 | 13 | 1.4 |
| 1154891 | 197 | 188 | 111 | 32 | 5.5 |
| 1154931 | 150 | 118 | 52 | 24 | 2.3 |
| 1154981 | 106 | 122 | 113 | 37 | >6.0 |
| 1154991 | 218 | 154 | 63 | 37 | 3.3 |
| 1155047 | 90 | 72 | 28 | 13 | 0.8 |
| 1155057 | 273 | 110 | 75 | 29 | 2.8 |
| 1155099 | 73 | 57 | 22 | 6 | 0.4 |
| 1155107 | 47 | 41 | 20 | 8 | <0.1 |
| 1155119 | 198 | 182 | 87 | 45 | 5.3 |
| 1155125 | 91 | 130 | 56 | 29 | 3.1 |

TABLE 67

Dose-dependent inhibition of human Foxp3 mRNA
expression by free uptake of modified oligonucleotides in
SUP-M2 cells

| ION No. | 93.75 nM | 375.0 nM | 1500.0 nM | 6000.0 nM | $IC_{50}$ (µM) |
|---|---|---|---|---|---|
| | | % UTC | | | |
| 911144 | 66 | 54 | 35 | 25 | 0.5 |
| 1154778 | 139 | 130 | 68 | 40 | 4.1 |
| 1154803 | 61 | 52 | 23 | 13 | 0.3 |
| 1154821 | 98 | 83 | 79 | 20 | 2.4 |
| 1154833 | 115 | 100 | 101 | 72 | >6.0 |
| 1154858 | 55 | 62 | 64 | 30 | 1.3 |
| 1154875 | 75 | 83 | 41 | 19 | 1.0 |
| 1154893 | 30 | 39 | 23 | 5 | <0.1 |
| 1154898 | 123 | 98 | 54 | 19 | 1.9 |
| 1154924 | 53 | 89 | 49 | 31 | 1.5 |
| 1154928 | 162 | 72 | 44 | 22 | 1.6 |
| 1154929 | 96 | 78 | 33 | 9 | 0.9 |
| 1154930 | 84 | 99 | 28 | 12 | 1.0 |
| 1155031 | 95 | 82 | 77 | 44 | >6.0 |
| 1155032 | 44 | 52 | 19 | 11 | 0.1 |
| 1155048 | 65 | 51 | 24 | 5 | 0.3 |
| 1155108 | 100 | 60 | 24 | 9 | 0.7 |
| 1155109 | 95 | 86 | 39 | 12 | 1.1 |
| 1155121 | 129 | 143 | 125 | 34 | >6.0 |

TABLE 68

Dose-dependent inhibition of human Foxp3 mRNA
expression by free uptake of modified oligonucleotides in
SUP-M2 cells

| ION No. | 93.75 nM | 375.0 nM | 1500.0 nM | 6000.0 nM | $IC_{50}$ (µM) |
|---|---|---|---|---|---|
| | | % UTC | | | |
| 911144 | 74 | 71 | 56 | 31 | 1.6 |
| 1154722 | 77 | 83 | 81 | 67 | >6.0 |
| 1154756 | 92 | 77 | 61 | 28 | 2.0 |
| 1154758 | 109 | 95 | 69 | 49 | 6.0 |
| 1154860 | 135 | 102 | 88 | 41 | 5.1 |
| 1154864 | 114 | 81 | 60 | 35 | 2.5 |
| 1154878 | 131 | 132 | 145 | 95 | >6.0 |
| 1154884 | 119 | 81 | 37 | 15 | 1.2 |
| 1154896 | 107 | 90 | 59 | 27 | 2.1 |
| 1154956 | 110 | 85 | 39 | 20 | 1.4 |
| 1154962 | 98 | 90 | 50 | 5 | 1.2 |
| 1155022 | 79 | 92 | 64 | 61 | >6.0 |
| 1155052 | 92 | 69 | 36 | 17 | 0.9 |
| 1155058 | 112 | 125 | 110 | 57 | >6.0 |
| 1155070 | 71 | 63 | 53 | 23 | 0.9 |
| 1155100 | 125 | 65 | 32 | 8 | 1.0 |
| 1155104 | 149 | 92 | 60 | 29 | 2.4 |
| 1155106 | 108 | 99 | 64 | 31 | 2.8 |
| 1155118 | 85 | 80 | 42 | 27 | 1.3 |

Example 6: Dose-Dependent Inhibition of Human Foxp3 in CD4 T-Cells by cEt Gapmers Modified oligonucleotides described in the studies above were tested at various doses in primary PBMC-derived CD4 T-cells. Total human CD4 T-cells were purified from human peripheral blood leukapheresis sample (Leukopak, Stemcell Technologies) using Easysep human CD4 T-cell isolation kit (Stemcell Technologies). Purified human CD4 cells were cultured in Immunocult-XT T-cell expansion media (Stemcell Technologies) supplemented with 30 ng/mL of human recombinant IL-2 (Stemcell Technologies). Cultured CD4 T-cells at a density of 50,000 cells per well were treated using free uptake with modified oligonucleotides diluted to concentrations specified in the tables below. After a 48 hour incubation, Foxp3 mRNA levels were measured as previously described using the Human Foxp3 primer-probe set RTS35925. Foxp3 mRNA levels were adjusted according to total RNA content, as measured by RIBOGREEN®. Results are presented in the tables below as percent control of the amount of Foxp3 mRNA relative to untreated control cells (% UTC).

TABLE 69

Dose-dependent inhibition of human Foxp3 mRNA expression by free uptake of modified oligonucleotides in CD4 T-cells

| ION No. | % UTC | | | |
|---|---|---|---|---|
| | 109.4 nM | 437.5 nM | 1750.0 nM | 7000.0 nM |
| 141923 | 128 | 104 | 85 | 89 |
| 911144 | 88 | 63 | 61 | 56 |
| 1062008 | 63 | 94 | 104 | 107 |
| 1062010 | 107 | 93 | 96 | 80 |
| 1062086 | 128 | 111 | 120 | 120 |
| 1062413 | 62 | 63 | 58 | 59 |
| 1062425 | 70 | 47 | 54 | 39 |
| 1062428 | 77 | 72 | 71 | 63 |
| 1062529 | 111 | 125 | 125 | 125 |
| 1062760 | 94 | 111 | 109 | 134 |
| 1062891 | 108 | 104 | 101 | 84 |
| 1062938 | 81 | 62 | 59 | 46 |
| 1063101 | 117 | 81 | 89 | 85 |
| 1063237 | 98 | 121 | 121 | 106 |
| 1063238 | 122 | 118 | 149 | 120 |
| 1063268 | 71 | 51 | 46 | 40 |
| 1063619 | 103 | 109 | 127 | 127 |
| 1063963 | 84 | 80 | 83 | 81 |
| 1063976 | 89 | 84 | 79 | 50 |
| 1064313 | 80 | 79 | 64 | 52 |

TABLE 70

Dose-dependent inhibition of human Foxp3 mRNA expression by free uptake of modified oligonucleotides in CD4 T-cells

| ION No. | % UTC | | | |
|---|---|---|---|---|
| | 109.4 nM | 437.5 nM | 1750.0 nM | 7000.0 nM |
| 141923 | 109 | 114 | 84 | 71 |
| 911144 | 80 | 59 | 62 | 51 |
| 1062247 | 79 | 84 | 109 | 86 |
| 1062397 | 100 | 87 | 89 | 93 |
| 1062580 | 103 | 103 | 98 | 101 |
| 1062668 | 73 | 38 | 52 | 41 |
| 1062669 | 83 | 75 | 92 | 82 |
| 1062835 | 111 | 100 | 82 | 85 |
| 1062937 | 75 | 76 | 57 | 46 |
| 1063032 | 84 | 88 | 100 | 76 |
| 1063038 | 100 | 93 | 107 | 111 |
| 1063058 | 90 | 93 | 96 | 103 |
| 1063320 | 96 | 108 | 97 | 124 |
| 1063649 | 82 | 87 | 74 | 60 |
| 1063734 | 58 | 48 | 43 | 32 |
| 1063735 | 95 | 86 | 81 | 89 |
| 1063744 | 102 | 90 | 94 | 108 |
| 1063921 | 95 | 73 | 87 | 91 |
| 1063946 | 79 | 62 | 86 | 56 |
| 1064096 | 74 | 73 | 59 | 62 |

TABLE 71

Dose-dependent inhibition of human Foxp3 mRNA expression by free uptake of modified oligonucleotides in CD4 T-cells

| ION No. | % UTC | | | |
|---|---|---|---|---|
| | 109.4 nM | 437.5 nM | 1750.0 nM | 7000.0 nM |
| 141923 | 113 | 101 | 111 | 110 |
| 582468 | 106 | 115 | 83 | 107 |
| 911144 | 68 | 78 | 51 | 67 |
| 911179 | 115 | 72 | 79 | 71 |
| 1062007 | 107 | 103 | 113 | 106 |
| 1062044 | 102 | 142 | 98 | 130 |
| 1062375 | 121 | 102 | 94 | 102 |
| 1062641 | 90 | 88 | 66 | 103 |
| 1062712 | 84 | 126 | 55 | 142 |
| 1062802 | 99 | 122 | 110 | 98 |
| 1062834 | 101 | 108 | 111 | 97 |
| 1062840 | 112 | 107 | 129 | 142 |
| 1062857 | 124 | 162 | 114 | 169 |
| 1063035 | 137 | 141 | 137 | 78 |
| 1063037 | 78 | 109 | 101 | 114 |
| 1063097 | 175 | 122 | 122 | 109 |
| 1063650 | 95 | 175 | 99 | 160 |
| 1063655 | 65 | 71 | 59 | 46 |
| 1063895 | 33 | 10 | 7 | 5 |
| 1063910 | 93 | 116 | 105 | 93 |

Example 7: Dose-Dependent Inhibition of Human Foxp3 in Regulatory T-Cells (T-Reg) by cEt Gapmers Modified oligonucleotides described in the studies above were tested at various doses in in vitro differentiated regulatory T-cells. T-regs were differentiated for 2 weeks from naïve human CD4 cells (purified from frozen PBMCs (Stemcell technologies) using EasySep human naïve CD4 T-cell isolation kit (Stemcell technologies)) in Immunocult-XT T-cell expansion media (Stemcell Technologies) supplemented with ImmunoCult Human Treg Differentiation Supplement and ImmunoCult Human CD3/CD28 T-cell Activator (Stemcell Technologies). Cultured T-reg cells at a density of 20,000 cells per well were treated using free uptake with modified oligonucleotides diluted to concentrations specified in the tables below. After a 48 hour incubation, Foxp3 mRNA levels were measured as previously described using the Human Foxp3 primer-probe set RTS35925. Foxp3 mRNA levels were adjusted according to total RNA content, as measured by RIBOGREEN®. Results are presented in the tables below as percent control of the amount of Foxp3 mRNA relative to untreated control cells (% UTC).

TABLE 72

Dose-dependent inhibition of human Foxp3 mRNA expression by free uptake of modified oligonucleotides in T-reg cells

| ION No. | % UTC | | | |
|---|---|---|---|---|
| | 370.4 nM | 1111.1 nM | 3333.3 nM | 10000.0 nM |
| 1062010 | 99 | 107 | 98 | 118 |
| 1062835 | 89 | 92 | 102 | 87 |
| 1062247 | 97 | 110 | 120 | 113 |
| 1062840 | 94 | 84 | 83 | 83 |
| 1062413 | 94 | 85 | 74 | 75 |

TABLE 72-continued

Dose-dependent inhibition of human Foxp3 mRNA expression by free uptake of modified oligonucleotides in T-reg cells

| | % UTC | | | |
|---|---|---|---|---|
| ION No. | 370.4 nM | 1111.1 nM | 3333.3 nM | 10000.0 nM |
| 1062857 | 103 | 97 | 94 | 98 |
| 1062428 | 108 | 111 | 105 | 100 |
| 1062891 | 90 | 87 | 72 | 61 |
| 1062641 | 107 | 116 | 114 | 110 |
| 1062937 | 88 | 69 | 63 | 59 |
| 1063101 | 112 | 107 | 106 | 87 |
| 1062669 | 94 | 95 | 86 | 72 |
| 1062938 | 93 | 80 | 65 | 50 |
| 911179 | 98 | 95 | 76 | 57 |
| 1062712 | 113 | 95 | 104 | 107 |
| 1063035 | 99 | 96 | 103 | 86 |
| 1062802 | 106 | 105 | 106 | 99 |
| 1063037 | 104 | 90 | 91 | 67 |

TABLE 73

Dose-dependent inhibition of human Foxp3 mRNA expression by free uptake of modified oligonucleotides in T-reg cells

| | % UTC | | | |
|---|---|---|---|---|
| ION No. | 370.4 nM | 1111.1 nM | 3333.3 nM | 10000.0 nM |
| 1063238 | 102 | 99 | 99 | 94 |
| 1063734 | 75 | 64 | 54 | 35 |
| 1063248 | 92 | 113 | 100 | 107 |
| 1064096 | 85 | 81 | 74 | 72 |
| 1063268 | 97 | 100 | 105 | 88 |
| 1064313 | 97 | 92 | 92 | 81 |
| 1063320 | 113 | 119 | 125 | 129 |
| 1063619 | 108 | 111 | 120 | 115 |
| 911179 | 97 | 77 | 65 | 54 |
| 1063649 | 96 | 98 | 109 | 96 |
| 911144 | 104 | 104 | 89 | 61 |
| 1063650 | 96 | 89 | 82 | 61 |
| 1063655 | 95 | 91 | 87 | 80 |

TABLE 74

Dose-dependent inhibition of human Foxp3 mRNA expression by free uptake of modified oligonucleotides in T-reg cells

| | % UTC | | | |
|---|---|---|---|---|
| ION No. | 370.4 nM | 1111.1 nM | 3333.3 nM | 10000.0 nM |
| 1062010 | 93 | 111 | 103 | 115 |
| 1062835 | 90 | 100 | 102 | 81 |
| 1062247 | 86 | 90 | 99 | 96 |
| 1062840 | 97 | 84 | 86 | 75 |
| 1062413 | 73 | 77 | 61 | 58 |
| 1062857 | 118 | 94 | 81 | 87 |
| 1062428 | 74 | 86 | 77 | 83 |
| 1062891 | 79 | 67 | 70 | 47 |
| 1062641 | 77 | 84 | 91 | 71 |
| 1062937 | 66 | 66 | 58 | 41 |
| 1063101 | 97 | 80 | 74 | 59 |
| 1062669 | 64 | 66 | 62 | 56 |
| 1062938 | 58 | 48 | 41 | 32 |
| 911179 | 88 | 66 | 62 | 47 |
| 1062712 | 66 | 64 | 68 | 64 |
| 1063035 | 59 | 60 | 61 | 46 |

TABLE 74-continued

Dose-dependent inhibition of human Foxp3 mRNA expression by free uptake of modified oligonucleotides in T-reg cells

| | % UTC | | | |
|---|---|---|---|---|
| ION No. | 370.4 nM | 1111.1 nM | 3333.3 nM | 10000.0 nM |
| 1062802 | 55 | 65 | 75 | 71 |
| 1063037 | 58 | 58 | 47 | 41 |

TABLE 75

Dose-dependent inhibition of human Foxp3 mRNA expression by free uptake of modified oligonucleotides in T-reg cells

| | % UTC | | | |
|---|---|---|---|---|
| ION No. | 370.4 nM | 1111.1 nM | 3333.3 nM | 10000.0 nM |
| 1063238 | 111 | 108 | 81 | 70 |
| 1063734 | 90 | 80 | 56 | 40 |
| 1063248 | 97 | 105 | 102 | 102 |
| 1064096 | 85 | 88 | 75 | 69 |
| 1063268 | 94 | 92 | 94 | 87 |
| 1064313 | 95 | 89 | 71 | 61 |
| 1063320 | 79 | 80 | 82 | 88 |
| 1063619 | 86 | 91 | 84 | 92 |
| 911179 | 59 | 56 | 54 | 40 |
| 1063649 | 65 | 69 | 64 | 69 |
| 911144 | 81 | 66 | 58 | 47 |
| 1063650 | 56 | 50 | 47 | 34 |
| 1063655 | 70 | 67 | 61 | 57 |

Example 8: Tolerability of Modified Oligonucleotides Targeting Human Foxp3 in Balb/c Mice Balb/c mice were treated with modified oligonucleotides selected from studies described above and evaluated for changes in the levels of various plasma chemistry markers.

Treatment

Groups of female Balb/c mice (obtained from Charles River) were injected subcutaneously twice a week for three weeks (for a total of 7 treatments) with 50 mg/kg of modified oligonucleotides. One group of female Balb/c mice was injected with PBS. Mice were euthanized on day 21 post start of treatment (24 hours following the final administration).

Plasma Chemistry Markers

To evaluate the effect of modified oligonucleotides on liver function, plasma levels of blood urea nitrogen (BUN), albumin, alanine aminotransferase (ALT), aspartate aminotransferase (AST), total bilirubin (TBIL), and albumin (ALB) were measured using an automated clinical chemistry analyzer (Hitachi Olympus AU400c, Melville, N.Y.). The results are presented in the Table below. Modified oligonucleotides that caused changes in the levels of any of the liver or kidney function markers outside the expected range for modified oligonucleotides were excluded in further studies.

TABLE 76

Plasma chemistry markers in female Balb/c mice

| ION No. | Plasma clinical chemistry | | | | |
|---|---|---|---|---|---|
| | ALB (g/dL) | ALT (U/L) | AST (U/L) | TBIL (mg/dL) | BUN (mg/dL) |
| PBS | 2.6 | 86 | 108 | 0.3 | 19 |
| 549148 | 2.8 | 30 | 48 | 0.2 | 20 |
| 910956 | 2.7 | 992 | 1040 | 0.2 | 15 |
| 910959 | 3.2 | 1311 | 869 | 1.3 | 15 |
| 911019 | 3.6 | 1118 | 893 | 0.3 | 19 |
| 911101 | 2.8 | 1709 | 1506 | 0.7 | 13 |
| 911118 | 2.8 | 968 | 524 | 4.9 | 15 |
| 911144 | 2.7 | 1138 | 843 | 0.3 | 22 |
| L0911171 | 3.1 | 1144 | 1120 | 0.6 | 21 |
| 911179 | 2.9 | 453 | 353 | 0.2 | 20 |
| 911180 | 2.5 | 170 | 143 | 0.2 | 16 |

Body and Organ Weights

Body weights of Balb/c mice were measured on day 22, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 77

Body and organ weights (in grams)

| ION No. | body weight (g) | Liver (g) | Kidney (g) | Spleen (g) |
|---|---|---|---|---|
| PBS | 22 | 1.08 | 0.28 | 0.12 |
| 549148 | 21 | 1.16 | 0.29 | 0.12 |
| 910956 | 21 | 1.36 | 0.27 | 0.12 |
| 910959 | 22 | 1.38 | 0.35 | 0.12 |
| 911019 | 23 | 1.61 | 0.32 | 0.12 |
| 911101 | 18 | 1.48 | 0.26 | 0.13 |
| 911118 | 16 | 1.01 | 0.25 | 0.09 |
| 911144 | 22 | 1.49 | 0.26 | 0.15 |
| 911171 | 19 | 1.30 | 0.28 | 0.17 |
| 911179 | 20 | 1.26 | 0.25 | 0.14 |
| 911180 | 21 | 1.22 | 0.26 | 0.14 |

Example 9: Tolerability of Modified Oligonucleotides Targeting Human Foxp3 in CD-1 Mice CD-1 mice were treated with modified oligonucleotides selected from studies described above and evaluated for changes in the levels of various plasma chemistry markers.
Treatment Groups of male CD-1 mice (obtained from Charles River) were injected subcutaneously once a week for six weeks (for a total of 7 treatments) with 50 mg/kg of modified oligonucleotides. One group of male CD-1 mice was injected with PBS. Mice were euthanized on day 39 post start of treatment (24 hours following the final administration).
Plasma Chemistry Markers To evaluate the effect of modified oligonucleotides on liver function, plasma levels of blood urea nitrogen (BUN), albumin, alanine aminotransferase (ALT), aspartate aminotransferase (AST), total bilirubin (TBIL), and albumin (ALB) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 78

Plasma chemistry markers in male CD-1 mice

| ION No. | Plasma clinical chemistry | | | | |
|---|---|---|---|---|---|
| | ALB (g/dL) | ALT (U/L) | AST (U/L) | TBIL (mg/dL) | BUN (mg/dL) |
| PBS | 2.8 | 27 | 48 | 0.2 | 19 |
| 1062008 | 2.2 | 836 | 1125 | 9.1 | 24 |
| 1062010 | 2.2 | 105 | 139 | 0.2 | 18 |
| 1062385 | 2.4 | 3206 | 3112 | 0.7 | 20 |
| 1062425 | 2.5 | 612 | 490 | 7.1 | 19 |
| 1062545 | 2.3 | 74 | 70 | 0.2 | 21 |
| 1062641 | 2.3 | 86 | 95 | 0.1 | 21 |
| 1062838 | 2.4 | 178 | 232 | 0.3 | 18 |
| 1062903 | 2.5 | 220 | 408 | 0.3 | 18 |
| 1062907 | 3.2 | 2055 | 1321 | 2.4 | 21 |
| 1062937 | 2.6 | 100 | 97 | 0.2 | 22 |
| 1063038 | 2.8 | 480 | 279 | 0.2 | 19 |
| 1063158 | 2.6 | 37 | 56 | 0.2 | 21 |
| 1063414 | 3.0 | 2316 | 1649 | 0.3 | 21 |
| 1063734 | 2.7 | 63 | 76 | 0.2 | 18 |
| 1063984 | 3.0 | 1382 | 767 | 6.3 | 26 |
| 1064060 | 3.4 | 3034 | 1927 | 0.8 | 21 |
| 1064313 | 2.3 | 107 | 109 | 0.2 | 17 |

Body and Organ Weights

Body weights of CD-1 mice were measured on the day the mice were sacrificed, and the average body weight for each group is presented in the Table below. Kidney, spleen, and liver weights were measured at the end of the study and are presented in the Table below. Modified oligonucleotides that caused any changes in organ weights outside the expected range for modified oligonucleotides were excluded from further studies.

TABLE 79

Body and organ weights (in grams)

| ION No. | body weight (g) | Liver (g) | Kidney (g) | Spleen (g) |
|---|---|---|---|---|
| PBS | 38 | 1.88 | 0.58 | 0.12 |
| 1062008 | 34 | 2.65 | 0.49 | 0.84 |
| 1062010 | 40 | 2.21 | 0.57 | 0.18 |
| 1062385 | 37 | 2.65 | 0.60 | 0.19 |
| 1062425 | 33 | 3.13 | 0.46 | 0.18 |
| 1062545 | 36 | 2.09 | 0.56 | 0.12 |
| 1062641 | 40 | 2.31 | 0.54 | 0.20 |
| 1062838 | 39 | 2.04 | 0.53 | 0.14 |
| 1062903 | 33 | 2.04 | 0.55 | 0.16 |
| 1062907 | 37 | 3.85 | 0.54 | 0.19 |
| 1062937 | 38 | 2.23 | 0.63 | 0.13 |
| 1063038 | 39 | 2.56 | 0.65 | 0.27 |
| 1063158 | 39 | 1.96 | 0.62 | 0.13 |
| 1063414 | 35 | 2.75 | 0.67 | 0.17 |
| 1063734 | 39 | 2.05 | 0.59 | 0.14 |
| 1063984 | 28 | 2.09 | 0.38 | 0.07 |
| 1064060 | 36 | 2.64 | 0.58 | 0.08 |
| 1064313 | 39 | 2.04 | 0.62 | 0.14 |

Hematology Assays

Blood obtained from mouse groups at day 40 were sent to IDEXX BioResearch for measurement of blood cell counts. Counts taken include red blood cell (RBC) count, white blood cell (WBC) count, hemoglobin (HGB), hematocrit (HCT), Mean corpuscular volume (MCV), mean corpuscular hemoglobin (MCH), mean corpuscular hemoglobin concentration (MCHC), and individual white blood cell counts, such as that of monocytes (MON), neutrophils (NEU), lymphocytes (LYM), eosinophils (EOS), basophils (BAS), reticulocytes (RETIC) and platelets (PLT). The results are presented in the tables below. N.D refers to samples where data is not available. Ionis oligonucleotides that caused changes in the blood cell count outside the expected range for modified oligonucleotides were excluded in further studies.

TABLE 80

Blood Cell Count in CD-1 mice

| ION No. | RBC (M/uL) | Retic (K/uL) | HCT (%) | HGB (g/dL) | MCV (fL) | MCH (pg) | MCHC (g/dL) |
|---|---|---|---|---|---|---|---|
| PBS | 8 | 312 | 40 | 13 | 47 | 16 | 33 |
| 1062008 | 5 | 1308 | 36 | 9 | 72 | 18 | 26 |
| 1062010 | 10 | 310 | 43 | 15 | 45 | 15 | 34 |
| 1062385 | 8 | 339 | 37 | 12 | 45 | 15 | 32 |
| 1062425 | 8 | 272 | 36 | 11 | 47 | 15 | 32 |
| 1062545 | 9 | 267 | 41 | 14 | 45 | 15 | 33 |
| 1062641 | 8 | 332 | 38 | 13 | 45 | 15 | 33 |
| 1062838 | 8 | 299 | 40 | 12 | 48 | 15 | 31 |
| 1062903 | 8 | 431 | 39 | 12 | 50 | 16 | 32 |
| 1062907 | 9 | 410 | 42 | 13 | 46 | 14 | 31 |
| 1062937 | 11 | 346 | 52 | 17 | 47 | 15 | 33 |
| 1063038 | 8 | 279 | 40 | 12 | 50 | 15 | 30 |
| 1063158 | 11 | 376 | 50 | 16 | 47 | 15 | 31 |
| 1063414 | 8 | 154 | 36 | 11 | 48 | 15 | 31 |
| 1063734 | 10 | 328 | 48 | 14 | 47 | 14 | 30 |
| 1063984 | 8 | 381 | 38 | 11 | 50 | 15 | 31 |
| 1064060 | 8 | 303 | 35 | 11 | 45 | 14 | 31 |
| 1064313 | 10 | 350 | 49 | 15 | 47 | 15 | 31 |

TABLE 81

Blood Cell Count in CD-1 mice

| ION No. | WBC (K/uL) | LYM (/uL) | MON (/uL) | NEU (/uL) | EOS (/uL) | PLT (K/uL) |
|---|---|---|---|---|---|---|
| PBS | 4 | 2817 | 63 | 597 | 124 | 988 |
| 1062008 | 40 | 30502 | 1399 | 7366 | 379 | 208 |
| 1062010 | 6 | 3961 | 449 | 1159 | 181 | 775 |
| 1062385 | 21 | 12537 | 957 | 6621 | 572 | 1118 |
| 1062425 | 11 | 6560 | 1030 | 2608 | 692 | 963 |
| 1062545 | 4 | 3226 | 204 | 721 | 175 | 1182 |
| 1062641 | 3 | 2506 | 307 | 475 | 109 | 779 |
| 1062838 | 7 | 3961 | 539 | 1793 | 275 | 896 |
| 1062903 | 19 | 14165 | 1005 | 3595 | 451 | 595 |
| 1062907 | 8 | 5351 | 909 | 1635 | 193 | 885 |
| 1062937 | 4 | 2287 | 414 | 769 | 118 | 958 |
| 1063038 | 8 | 5063 | 1512 | 936 | 103 | 943 |
| 1063158 | 3 | 2145 | 210 | 707 | 108 | 1141 |
| 1063414 | 13 | 7724 | 1404 | 3786 | 270 | 1924 |
| 1063734 | 5 | 3822 | 795 | 644 | 92 | 1044 |
| 1063984 | 12 | 6263 | 1057 | 4238 | 232 | 1169 |
| 1064060 | 7 | 4110 | 1044 | 1459 | 94 | 1093 |
| 1064313 | 5 | 3475 | 515 | 1026 | 96 | 936 |

Example 10: Tolerability of Modified Oligonucleotides Targeting Human Foxp3 in CD-1 Mice CD-1 mice were treated with modified oligonucleotides selected from studies described above and evaluated for changes in the levels of various plasma chemistry markers.

Treatment

Groups of male CD-1 mice (obtained from Charles River) were injected subcutaneously once a week for six weeks (for a total of 7 treatments) with 50 mg/kg of modified oligonucleotides. One group of male CD-1 mice was injected with PBS. Mice were euthanized on day 40 post start of treatment (24 hours following the final administration). In addition, 6 additional groups of mice (treated with ION Nos. 1062413, 1062669, 1062712, 1062835, 1063655, and 1063946) were treated subcutaneously once a week for 5 weeks (a total of 6 treatments) with 50 mg/kg of modified oligonucleotides. Mice were euthanized on day 33 post start of treatment (24 hrs post following the final administration).

Plasma Chemistry Markers

To evaluate the effect of modified oligonucleotides on liver function, plasma levels of blood urea nitrogen (BUN), albumin, alanine aminotransferase (ALT), aspartate aminotransferase (AST), total bilirubin (TBIL), and albumin (ALB) were measured using an automated clinical chemistry analyzer (Hitachi Olympus AU400c, Melville, N.Y.). The results are presented in the Table below. Modified oligonucleotides that caused changes in the levels of any of the liver or kidney function markers outside the expected range for modified oligonucleotides were excluded in further studies.

TABLE 82

Plasma chemistry markers in male CD-1 mice

| | Plasma clinical chemistry | | | | |
|---|---|---|---|---|---|
| ION No. | ALB (g/dL) | ALT (U/L) | AST (U/L) | TBIL (mg/dL) | BUN (mg/dL) |
| PBS | 2.8 | 23 | 42 | 0.2 | 28 |
| 1062007 | 2.1 | 1051 | 1244 | 1.1 | 31 |
| 1062413 | 2.5 | 95 | 68 | 0.2 | 27 |
| 1062580 | 2.4 | 220 | 154 | 0.2 | 23 |
| 1062669 | 2.4 | 61 | 82 | 0.1 | 21 |
| 1062712 | 2.3 | 101 | 107 | 0.2 | 20 |
| 1062724 | 2.6 | 999 | 694 | 0.2 | 25 |
| 1062802 | 2.7 | 153 | 101 | 0.2 | 23 |
| 1062835 | 2.3 | 120 | 104 | 0.1 | 24 |
| 1062857 | 2.6 | 66 | 73 | 0.2 | 24 |
| 1062891 | 2.5 | 64 | 81 | 0.1 | 25 |
| 1063032 | 2.5 | 452 | 282 | 0.2 | 25 |
| 1063238 | 2.7 | 71 | 74 | 0.2 | 26 |
| 1063248 | 2.1 | 103 | 171 | 0.1 | 25 |
| 1063650 | 2.8 | 59 | 76 | 0.2 | 25 |
| 1063655 | 2.3 | 52 | 93 | 0.1 | 20 |
| 1063744 | 2.4 | 308 | 212 | 0.2 | 22 |
| 1063910 | 2.5 | 371 | 296 | 0.1 | 24 |
| 1063946 | 3.0 | 1136 | 696 | 0.5 | 24 |
| 1063981 | 3.3 | 767 | 909 | 3.0 | 27 |

Body and Organ Weights

Body weights of CD-1 mice were measured on the day the mice were sacrificed, and the average body weight for each group is presented in the Table below. Kidney, spleen, and liver weights were measured at the end of the study and are presented in the Table below. Modified oligonucleotides that caused any changes in organ weights outside the expected range for modified oligonucleotides were excluded from further studies.

TABLE 83

Body and organ weights (in grams)

| ION No. | body weight (g) | Liver (g) | Kidney (g) | Spleen (g) |
|---|---|---|---|---|
| PBS | 40 | 2.08 | 0.61 | 0.11 |
| 1062007 | 34 | 2.76 | 0.52 | 0.65 |

TABLE 83-continued

Body and organ weights (in grams)

| ION No. | body weight (g) | Liver (g) | Kidney (g) | Spleen (g) |
|---|---|---|---|---|
| 1062413 | 38 | 2.20 | 0.55 | 0.11 |
| 1062580 | 38 | 2.47 | 0.58 | 0.18 |
| 1062669 | 39 | 2.47 | 0.54 | 0.15 |
| 1062712 | 35 | 2.01 | 0.61 | 0.17 |
| 1062724 | 34 | 2.92 | 0.54 | 0.22 |
| 1062802 | 37 | 1.97 | 0.58 | 0.12 |
| 1062835 | 36 | 2.27 | 0.59 | 0.16 |
| 1062857 | 41 | 2.42 | 0.66 | 0.13 |
| 1062891 | 40 | 2.36 | 0.65 | 0.19 |
| 1063032 | 39 | 2.87 | 0.80 | 0.23 |
| 1063238 | 39 | 2.44 | 0.61 | 0.11 |
| 1063248 | 39 | 2.42 | 0.54 | 0.16 |
| 1063650 | 37 | 2.28 | 0.58 | 0.12 |
| 1063655 | 38 | 1.96 | 0.59 | 0.15 |
| 1063744 | 44 | 2.73 | 0.78 | 0.20 |
| 1063910 | 49 | 3.64 | 0.66 | 0.19 |
| 1063946 | 37 | 2.88 | 0.64 | 0.21 |
| 1063981 | 35 | 4.08 | 0.49 | 0.14 |

Hematology Assays

Blood obtained from mouse groups at day 40 were sent to IDEXX BioResearch for measurement of blood cell counts. Counts taken include red blood cell (RBC) count, white blood cell (WBC) count, hemoglobin (HGB), hematocrit (HCT), Mean corpuscular volume (MCV), mean corpuscular hemoglobin (MCH), mean corpuscular hemoglobin concentration (MCHC), and individual white blood cell counts, such as that of monocytes (MON), neutrophils (NEU), lymphocytes (LYM), eosinophils (EOS), basophils (BAS), reticulocytes (RETIC) and platelets (PLT). The results are presented in the tables below. Ionis oligonucleotides that caused changes in the blood cell count outside the expected range for modified oligonucleotides were excluded in further studies.

TABLE 84

Blood Cell Count in CD-1 mice

| ION No. | RBC (M/uL) | Retic (K/uL) | HCT (%) | HGB (g/dL) | MCV (fL) | MCH (pg) | MCHC (g/dL) |
|---|---|---|---|---|---|---|---|
| PBS | 700 | 4 | 262 | 8 | 12 | 3395 | 37 |
| 1062007 | 29943 | 65 | 1018 | 4 | 8 | 19758 | 32 |
| 1062413 | 892 | 6 | 267 | 8 | 12 | 4416 | 38 |
| 1062580 | 1585 | 18 | 258 | 8 | 12 | 15847 | 36 |
| 1062669 | 732 | 6 | 292 | 9 | 13 | 4748 | 40 |
| 1062712 | 661 | 6 | 287 | 9 | 14 | 4716 | 42 |
| 1062724 | 3723 | 21 | 521 | 8 | 12 | 15787 | 37 |
| 1062802 | 1088 | 8 | 235 | 7 | 10 | 6087 | 30 |
| 1062835 | 1172 | 6 | 302 | 10 | 15 | 4172 | 44 |
| 1062857 | 730 | 6 | 325 | 10 | 15 | 4736 | 43 |
| 1062891 | 988 | 7 | 284 | 8 | 13 | 5892 | 38 |
| 1063032 | 1678 | 12 | 434 | 10 | 15 | 9049 | 44 |
| 1063238 | 986 | 7 | 304 | 10 | 15 | 5537 | 43 |
| 1063248 | 1246 | 10 | 293 | 9 | 14 | 8042 | 42 |
| 1063650 | 542 | 6 | 266 | 9 | 13 | 4770 | 41 |
| 1063655 | 883 | 6 | 337 | 9 | 14 | 4277 | 41 |
| 1063744 | 1218 | 9 | 388 | 10 | 16 | 7135 | 49 |
| 1063910 | 1171 | 12 | 246 | 8 | 12 | 9552 | 37 |
| 1063946 | 2081 | 17 | 369 | 9 | 14 | 12975 | 41 |
| 1063981 | 3304 | 20 | 297 | 9 | 14 | 14916 | 43 |

TABLE 85

Blood Cell Count in CD-1 mice

| ION No. | WBC (K/uL) | LYM (/uL) | MON (/uL) | NEU (/uL) | EOS (/uL) | PLT (K/uL) |
|---|---|---|---|---|---|---|
| PBS | 210 | 70 | 47 | 15 | 33 | 458 |
| 1062007 | 5231 | 1215 | 75 | 20 | 26 | 148 |
| 1062413 | 277 | 235 | 47 | 15 | 33 | 1215 |
| 1062580 | 584 | 341 | 45 | 15 | 34 | 1186 |
| 1062669 | 401 | 194 | 47 | 15 | 33 | 1076 |
| 1062712 | 349 | 195 | 46 | 15 | 34 | 984 |
| 1062724 | 1454 | 253 | 44 | 14 | 32 | 1186 |
| 1062802 | 372 | 301 | 46 | 15 | 33 | 1289 |
| 1062835 | 249 | 158 | 46 | 16 | 34 | 979 |
| 1062857 | 233 | 198 | 45 | 15 | 34 | 1072 |
| 1062891 | 397 | 196 | 46 | 15 | 33 | 909 |
| 1063032 | 583 | 261 | 46 | 15 | 33 | 837 |
| 1063238 | 241 | 133 | 46 | 15 | 34 | 963 |
| 1063248 | 725 | 247 | 47 | 16 | 33 | 728 |
| 1063650 | 222 | 213 | 46 | 15 | 33 | 950 |
| 1063655 | 228 | 159 | 46 | 16 | 34 | 892 |
| 1063744 | 468 | 261 | 49 | 16 | 33 | 708 |
| 1063910 | 857 | 259 | 47 | 15 | 32 | 847 |
| 1063946 | 918 | 520 | 44 | 15 | 34 | 797 |
| 1063981 | 1230 | 362 | 48 | 15 | 32 | 899 |

Example 11: Tolerability of Modified Oligonucleotides Targeting Human Foxp3 in CD-1 Mice CD-1 mice were treated with modified oligonucleotides selected from studies described above and evaluated for changes in the levels of various plasma chemistry markers.

Treatment

Groups of male CD-1 mice (obtained from Charles River) were injected subcutaneously once a week for six weeks (for a total of 7 treatments) with 50 mg/kg of modified oligonucleotides. One group of male CD-1 mice was injected with PBS. Mice were euthanized on day 41 post start of treatment (24 hours following the final administration). In addition, 4 additional groups of mice (treated with ION Nos. 1062247, 1063619, 1063653, and 1064096) were treated subcutaneously once a week for 5 weeks (a total of 6 treatments) with 50 mg/kg of modified oligonucleotides. Mice were euthanized on day 38 post start of treatment (5 days following the final administration).

Plasma Chemistry Markers

To evaluate the effect of modified oligonucleotides on liver function, plasma levels of blood urea nitrogen (BUN), albumin, alanine aminotransferase (ALT), aspartate aminotransferase (AST), total bilirubin (TBIL), and albumin (ALB) were measured using an automated clinical chemistry analyzer (Hitachi Olympus AU400c, Melville, N.Y.). The results are presented in the table below. Modified oligonucleotides that caused changes in the levels of any of the liver or kidney function markers outside the expected range for modified oligonucleotides were excluded in further studies.

TABLE 86

Plasma chemistry markers in male CD-1 mice

| | Plasma clinical chemistry | | | | |
|---|---|---|---|---|---|
| ION No. | ALB (g/dL) | ALT (U/L) | AST (U/L) | TBIL (mg/dL) | BUN (mg/dL) |
| PBS | 3.4 | 27 | 44 | 0.18 | 33 |
| 1062034 | 3.7 | 623 | 401 | 0.19 | 28 |
| 1062044 | 3.7 | 2279 | 1471 | 3.13 | 33 |

TABLE 86-continued

Plasma chemistry markers in male CD-1 mice

Plasma clinical chemistry

| ION No. | ALB (g/dL) | ALT (U/L) | AST (U/L) | TBIL (mg/dL) | BUN (mg/dL) |
|---|---|---|---|---|---|
| 1062086 | 3.6 | 271 | 167 | 0.22 | 26 |
| 1062247 | 3.0 | 123 | 150 | 0.28 | 22 |
| 1062397 | 2.9 | 1455 | 1777 | 3.11 | 26 |
| 1062428 | 2.8 | 132 | 110 | 0.26 | 23 |
| 1062529 | 2.7 | 991 | 612 | 0.17 | 25 |
| 1062668 | 2.6 | 537 | 448 | 0.17 | 21 |
| 1062760 | 2.6 | 1086 | 603 | 0.24 | 20 |
| 1062840 | 2.6 | 38 | 52 | 0.17 | 25 |
| 1063035 | 2.3 | 97 | 110 | 0.14 | 23 |
| 1063037 | 2.5 | 99 | 89 | 0.15 | 21 |
| 1063058 | 2.4 | 1173 | 1307 | 0.24 | 26 |
| 1063097 | 3.0 | 1239 | 1219 | 0.99 | 27 |
| 1063101 | 2.7 | 48 | 62 | 0.21 | 25 |
| 1063237 | 3.1 | 1108 | 736 | 0.27 | 21 |
| 1063268 | 3.0 | 60 | 76 | 0.21 | 26 |
| 1063320 | 3.4 | 69 | 72 | 0.25 | 23 |
| 1063619 | 3.1 | 99 | 126 | 0.26 | 26 |
| 1063649 | 3.0 | 67 | 85 | 0.18 | 20 |
| 1063653 | 3.7 | 3499 | 2440 | 1.11 | 31 |
| 1063735 | 2.7 | 1440 | 1224 | 0.36 | 22 |
| 1063895 | 3.1 | 1533 | 1261 | 0.63 | 24 |
| 1063921 | 1.3 | 674 | 1603 | 2.70 | 29 |
| 1063963 | 3.1 | 2918 | 2985 | 0.98 | 24 |
| 1064096 | 3.0 | 31 | 103 | 0.22 | 23 |

Body and Organ Weights

Body weights of CD-1 mice were measured on the day the mice were sacrificed, and the average body weight for each group is presented in the table below. Kidney, spleen, and liver weights were measured at the end of the study and are presented in the table below. Modified oligonucleotides that caused any changes in organ weights outside the expected range for modified oligonucleotides were excluded from further studies.

TABLE 87

Body and organ weights (in grams)

| ION No. | body weight (g) | Liver (g) | Kidney (g) | Spleen (g) |
|---|---|---|---|---|
| PBS | 37 | 1.97 | 0.58 | 0.10 |
| 1062034 | 41 | 2.64 | 0.66 | 0.16 |
| 1062044 | 35 | 3.50 | 0.54 | 0.15 |
| 1062086 | 37 | 2.52 | 0.53 | 0.15 |
| 1062247 | 37 | 2.13 | 0.57 | 0.14 |
| 1062397 | 36 | 2.52 | 0.54 | 0.13 |
| 1062428 | 36 | 2.31 | 0.51 | 0.14 |
| 1062529 | 41 | 3.63 | 0.73 | 0.27 |
| 1062668 | 35 | 2.37 | 0.56 | 0.17 |
| 1062760 | 37 | 2.58 | 0.58 | 0.15 |
| 1062840 | 41 | 2.43 | 0.68 | 0.20 |
| 1063035 | 42 | 2.52 | 0.61 | 0.18 |
| 1063037 | 43 | 2.76 | 0.63 | 0.21 |
| 1063058 | 36 | 2.75 | 0.57 | 0.20 |
| 1063097 | 35 | 2.67 | 0.52 | 0.19 |
| 1063101 | 42 | 2.42 | 0.67 | 0.16 |
| 1063237 | 38 | 2.74 | 0.51 | 0.15 |
| 1063268 | 40 | 2.19 | 0.51 | 0.12 |
| 1063320 | 42 | 2.64 | 0.62 | 0.18 |
| 1063619 | 37 | 36.75 | 2.10 | 0.56 |
| 1063649 | 37 | 2.18 | 0.55 | 0.17 |
| 1063653 | 35 | 3.54 | 0.57 | 0.13 |
| 1063735 | 41 | 2.39 | 0.56 | 0.18 |
| 1063895 | 40 | 3.29 | 0.66 | 0.20 |
| 1063921 | 35 | 1.19 | 0.35 | 0.06 |

TABLE 87-continued

Body and organ weights (in grams)

| ION No. | body weight (g) | Liver (g) | Kidney (g) | Spleen (g) |
|---|---|---|---|---|
| 1063963 | 30 | 3.14 | 0.46 | 0.09 |
| 1064096 | 41 | 2.14 | 0.58 | 0.18 |

Hematology Assays

Blood obtained from mouse groups at day 40 were sent to IDEXX BioResearch for measurement of blood cell counts. Counts taken include red blood cell (RBC) count, white blood cell (WBC) count, hemoglobin (HGB), hematocrit (HCT), Mean corpuscular volume (MCV), mean corpuscular hemoglobin (MCH), mean corpuscular hemoglobin concentration (MCHC), and individual white blood cell counts, such as that of monocytes (MON), neutrophils (NEU), lymphocytes (LYM), eosinophils (EOS), basophils (BAS), reticulocytes (RETIC) and platelets (PLT). The results are presented in the tables below. N/A below refers to samples where data is not available due to insufficient blood volume. Ionis oligonucleotides that caused changes in the blood cell count outside the expected range for modified oligonucleotides were excluded in further studies.

TABLE 88

Blood Cell Count in CD-1 mice

| ION No. | RBC (M/uL) | Retic (K/uL) | HCT (%) | HGB (g/dL) | MCV (fL) | MCH (pg) | MCHC (g/dL) |
|---|---|---|---|---|---|---|---|
| PBS | 9 | 306 | 40 | 14 | 45 | 15 | 33 |
| 1062034 | 8 | 230 | 35 | 11 | 44 | 14 | 33 |
| 1062044 | 9 | 303 | 40 | 13 | 46 | 15 | 33 |
| 1062086 | 8 | 223 | 34 | 11 | 45 | 15 | 33 |
| 1062247 | 9 | 334 | 41 | 14 | 48 | 16 | 33 |
| 1062397 | 7 | 280 | 31 | 10 | 46 | 15 | 33 |
| 1062428 | 10 | 319 | 43 | 14 | 45 | 15 | 33 |
| 1062529 | 9 | 246 | 39 | 13 | 42 | 15 | 34 |
| 1062668 | 9 | 331 | 42 | 14 | 44 | 15 | 33 |
| 1062760 | 9 | 266 | 41 | 14 | 45 | 15 | 34 |
| 1062840 | 9 | 274 | 41 | 13 | 46 | 15 | 33 |
| 1063035 | 9 | 232 | 39 | 13 | 46 | 15 | 33 |
| 1063037 | 7 | 260 | 33 | 11 | 48 | 15 | 32 |
| 1063058 | 9 | 313 | 41 | 13 | 47 | 15 | 33 |
| 1063097 | 10 | 329 | 48 | 15 | 48 | 15 | 32 |
| 1063101 | 10 | 273 | 49 | 15 | 50 | 15 | 31 |
| 1063237 | 9 | 213 | 39 | 13 | 44 | 15 | 33 |
| 1063268 | 11 | 297 | 51 | 16 | 48 | 15 | 31 |
| 1063320 | 10 | 271 | 46 | 15 | 46 | 15 | 32 |
| 1063619 | 8 | 269 | 39 | 13 | 47 | 15 | 33 |
| 1063649 | 10 | 255 | 44 | 14 | 46 | 15 | 32 |
| 1063653 | 8 | 421 | 35 | 11 | 46 | 15 | 32 |
| 1063735 | 9 | 325 | 44 | 14 | 47 | 15 | 32 |
| 1063895 | 10 | 314 | 44 | 14 | 45 | 14 | 33 |
| 1063921 | N/A | N/A | N/A | N/A | N/A | N/A | N/A |
| 1063963 | 9 | 394 | 44 | 14 | 48 | 15 | 32 |
| 1064096 | 8 | 316 | 37 | 12 | 46 | 15 | 33 |

TABLE 89

Blood Cell Count in CD-1 mice

| ION No. | WBC (K/uL) | LYM (/uL) | MON (/uL) | NEU (/uL) | EOS (/uL) | PLT (K/uL) |
|---|---|---|---|---|---|---|
| PBS | 6 | 4358 | 234 | 1097 | 133 | 1251 |
| 1062034 | 12 | 9581 | 718 | 1333 | 384 | 951 |
| 1062044 | 23 | 11726 | 1569 | 2757 | 521 | 1370 |
| 1062086 | 9 | 7082 | 743 | 1371 | 201 | 1066 |
| 1062247 | 6 | 4230 | 517 | 1447 | 75 | 971 |
| 1062397 | 21 | 15205 | 1188 | 4188 | 236 | 547 |
| 1062428 | 9 | 6947 | 526 | 875 | 222 | 1002 |
| 1062529 | 6 | 3214 | 461 | 2504 | 103 | 887 |
| 1062668 | 14 | 10018 | 1248 | 2217 | 378 | 1048 |
| 1062760 | 7 | 4690 | 517 | 1352 | 200 | 851 |
| 1062840 | 5 | 4274 | 506 | 594 | 102 | 772 |
| 1063035 | 11 | 8936 | 533 | 1402 | 294 | 1097 |
| 1063037 | 5 | 3493 | 69 | 1467 | 13 | 461 |
| 1063058 | 22 | 16671 | 1649 | 3215 | 324 | 942 |
| 1063097 | 15 | 10425 | 2326 | 1692 | 314 | 880 |
| 1063101 | 6 | 4212 | 503 | 953 | 124 | 990 |
| 1063237 | 5 | 3996 | 536 | 760 | 172 | 1242 |
| 1063268 | 5 | 4341 | 365 | 616 | 86 | 1082 |
| 1063320 | 7 | 5701 | 367 | 700 | 124 | 1129 |
| 1063619 | 6 | 4783 | 622 | 832 | 185 | 1198 |
| 1063649 | 7 | 5429 | 430 | 902 | 161 | 1116 |
| 1063653 | 18 | 9995 | 2571 | 4439 | 1228 | 1465 |
| 1063735 | 6 | 4547 | 630 | 1016 | 70 | 819 |
| 1063895 | 11 | 7987 | 965 | 1877 | 113 | 1223 |
| 1063921 | N/A | N/A | N/A | N/A | N/A | N/A |
| 1063963 | 25 | 15990 | 2336 | 5937 | 940 | 1443 |
| 1064096 | 10 | 8031 | 661 | 858 | 195 | 986 |

Example 12: Tolerability of Modified Oligonucleotides Targeting Human Foxp3 in Sprague-Dawley Rats Sprague-Dawley rats are a multipurpose model used for safety and efficacy evaluations. The rats were treated with Ionis modified oligonucleotides from the studies described in the Examples above and evaluated for changes in the levels of various plasma chemistry markers.

Treatment

Male Sprague-Dawley rats were maintained on a 12-hour light/dark cycle and fed ad libitum with Purina normal rat chow. Groups of 4 Sprague-Dawley rats each were weekly injected subcutaneously with 50 mg/kg of Ionis oligonucleotide for 6 weeks (total 7 doses). In addition, a group of 3 Sprague-Dawley rats was injected subcutaneously with saline for the same time period. Forty-eight hours after the last dose, the rats were euthanized; and organs, urine and plasma were harvested for further analysis.

Plasma Chemistry Markers

To evaluate the effect of Ionis oligonucleotides on hepatic function, plasma levels of transaminases were measured using an automated clinical chemistry analyzer (Hitachi Olympus AU400c, Melville, N.Y.). Plasma levels of ALT (alanine transaminase) and AST (aspartate transaminase) were measured and the results are presented in the Table below expressed in IU/L. Plasma levels of total bilirubin (TBIL), albumin (ALB), and blood urea nitrogen (BUN) were also measured using the same clinical chemistry analyzer and the results are also presented in the Table below. Ionis modified oligonucleotides that caused changes in the levels of any markers of liver function outside the expected range for modified oligonucleotides were excluded in further studies.

TABLE 90

Plasma chemistry markers in Sprague-Dawley rats

| ION NO. | ALB (g/dL) | ALT (IU/L) | AST (IU/L) | TBIL (mg/dL) | BUN (mg/dL) |
|---|---|---|---|---|---|
| Saline | 3.7 | 66 | 105 | 0.15 | 18 |
| 1062428 | 4.2 | 146 | 149 | 0.23 | 26 |
| 1062641 | 3.2 | 75 | 155 | 0.12 | 20 |
| 1062835 | 1.9 | 45 | 70 | 0.12 | 64 |
| 1062937 | 3.1 | 129 | 164 | 0.16 | 23 |
| 1063268 | 3.5 | 79 | 121 | 0.13 | 20 |
| 1063649 | 3.6 | 141 | 207 | 0.20 | 20 |
| 1063655 | 3.2 | 89 | 170 | 0.17 | 24 |
| 1063734 | 3.4 | 62 | 121 | 0.15 | 20 |
| 1064096 | 3.1 | 74 | 163 | 0.17 | 28 |
| 1064313 | 2.8 | 117 | 186 | 0.16 | 27 |

Hematology Assays

Blood obtained from mouse groups at week 6 were sent to IDEXX BioResearch for measurement of blood cell counts. Counts taken include red blood cell (RBC) count, white blood cell (WBC) count, hemoglobin (HGB), hematocrit (HCT), mean corpuscular volume (MCV), mean corpuscular hemoglobin (MCH), mean corpuscular hemoglobin concentration (MCHC), and individual white blood cell counts, such as that of monocytes (MON), neutrophils (NEU), lymphocytes (LYM), eosinophils (EOS), reticulocytes (RETIC) and platelets (PLT). The results are presented in the tables below. Ionis oligonucleotides that caused changes in the blood cell count outside the expected range for modified oligonucleotides were excluded in further studies.

TABLE 91

Blood Cell Count in Sprague-Dawley Rats

| ION No. | RBC (M/uL) | WBC (K/uL) | HGB (g/dL) | HCT (%) | MCV (fL) | MCH (pg) | MCHC (g/dL) |
|---|---|---|---|---|---|---|---|
| Saline | 8 | 14 | 15 | 47 | 57 | 19 | 33 |
| 1062428 | 7 | 20 | 14 | 42 | 61 | 20 | 32 |
| 1062641 | 7 | 22 | 14 | 41 | 57 | 19 | 33 |
| 1062835 | 9 | 15 | 16 | 47 | 54 | 18 | 33 |
| 1062937 | 8 | 17 | 13 | 41 | 53 | 17 | 33 |
| 1063268 | 7 | 15 | 13 | 39 | 55 | 18 | 32 |
| 1063649 | 7 | 12 | 13 | 41 | 54 | 18 | 33 |
| 1063655 | 8 | 12 | 14 | 43 | 55 | 18 | 33 |
| 1063734 | 8 | 18 | 15 | 45 | 55 | 18 | 33 |
| 1064096 | 7 | 21 | 13 | 40 | 56 | 18 | 33 |
| 1064313 | 8 | 15 | 14 | 42 | 54 | 18 | 33 |

TABLE 92

Blood Cell Count in Sprague-Dawley Rats

| ION No. | MON (/uL) | NEU (/uL) | LYM (/uL) | EOS (/uL) | RETIC (K/uL) | PLT (K/uL) |
|---|---|---|---|---|---|---|
| Saline | 670 | 1296 | 11523 | 130 | 328 | 737 |
| 1062428 | 2742 | 602 | 16053 | 68 | 373 | 457 |
| 1062641 | 2344 | 1951 | 17379 | 56 | 194 | 567 |
| 1062835 | 1598 | 2239 | 10485 | 200 | 289 | 939 |
| 1062937 | 1856 | 1390 | 13361 | 48 | 244 | 604 |
| 1063268 | 821 | 1203 | 12352 | 88 | 132 | 611 |
| 1063649 | 1013 | 1048 | 9398 | 68 | 218 | 663 |
| 1063655 | 1113 | 1635 | 9214 | 115 | 207 | 728 |
| 1063734 | 1785 | 899 | 15240 | 42 | 276 | 702 |
| 1064096 | 1754 | 1126 | 17788 | 158 | 259 | 620 |
| 1064313 | 1268 | 638 | 12587 | 69 | 231 | 428 |

Kidney Function

To evaluate the effect of Ionis oligonucleotides on kidney function, urinary levels of total protein and creatinine were measured using an automated clinical chemistry analyzer (Hitachi Olympus AU400c, Melville, N.Y.). The ratios of total protein to creatinine (P/C ratio) are presented in the Table below. Ionis oligonucleotides that caused changes in the levels of the ratio outside the expected range for modified oligonucleotides were excluded in further studies.

TABLE 93

Total protein to creatinine ratio in Sprague-Dawley rats

| ION NO. | URINE P/C ratio |
|---|---|
| Saline | 1.0 |
| 1062428 | 5.5 |
| 1062641 | 7.4 |
| 1062835 | 11.1 |
| 1062937 | 7.4 |
| 1063268 | 4.4 |
| 1063649 | 3.8 |
| 1063655 | 7.7 |
| 1063734 | 5.4 |
| 1064096 | 5.6 |
| 1064313 | 9.1 |

Body and Organ Weights

Liver, heart, spleen and kidney weights were measured at the end of the study and are presented in the table below. Terminal body weight was measured prior to necropsy. Ionis oligonucleotides that caused any changes in organ weights outside the expected range for modified oligonucleotides were excluded from further studies.

TABLE 94

Body and Organ weights

| ION No. | Body Weight (g) | Liver (g) | Kidney (g) | Spleen (g) |
|---|---|---|---|---|
| Saline | 467 | 19 | 3.4 | 0.9 |
| 1062428 | 348 | 15 | 2.6 | 1.1 |
| 1062641 | 352 | 18 | 3.0 | 2.4 |
| 1062835 | 379 | 17 | 3.4 | 1.4 |
| 1062937 | 360 | 15 | 3.3 | 1.4 |
| 1063268 | 418 | 18 | 3.0 | 1.1 |
| 1063649 | 385 | 19 | 3.6 | 1.7 |
| 1063655 | 398 | 21 | 4.0 | 2.5 |
| 1063734 | 341 | 17 | 2.9 | 1.5 |
| 1064096 | 397 | 20 | 4.2 | 3.7 |
| 1064313 | 381 | 20 | 4.4 | 2.8 |

Example 13: Effect of Modified Oligonucleotides on Human FOXP3 Expression in a Humanized PBMC Mouse Model Humanized PBMC mice obtained from Jackson Laboratory (hu-PBMC-NSG). NOD.Cg-Prkdcscid Il2rgtm1Wj1/SzJ mice were engrafted with human PBMCs to generate the hu-PBMC-NSG model. Mice were treated with modified oligonucleotides selected from studies described above and evaluated for changes in the levels of various plasma chemistry markers as well as mRNA.

Treatment

Groups of 4 female hu-PBMC-NSG mice (obtained from Jackson Laboratory) were injected subcutaneously daily (for a total of 4 treatments) with 25 mg/kg of modified oligonucleotides. Mice were treated with modified oligonucleotide in groups of 4. One additional group of 8 female huPBMC mice was injected with PBS. Mice were euthanized on day 4 post start of treatment (24 hours following the final administration).

Plasma Chemistry Markers

To evaluate the effect of modified oligonucleotides on liver function, plasma levels of blood urea nitrogen (BUN), albumin, alanine aminotransferase (ALT), aspartate aminotransferase (AST), total bilirubin (TBIL), and albumin (ALB) were measured using an automated clinical chemistry analyzer (Hitachi Olympus AU400c, Melville, N.Y.). The results are presented in the Table below. Modified oligonucleotides that caused changes in the levels of any of the liver or kidney function markers outside the expected range for modified oligonucleotides were excluded in further studies.

TABLE 95

Plasma chemistry markers in female huPBMC mice

| ION NO. | Albumin (g/dL) | ALT (U/L) | AST (U/L) | TBIL (mg/dL) | BUN (mg/dL) |
|---|---|---|---|---|---|
| PBS | 3.1 | 26 | 73 | 0.24 | 22 |
| 549148 | 3.1 | 36 | 78 | 0.19 | 21 |
| 1062413 | 3.0 | 58 | 115 | 0.20 | 24 |
| 1062428 | 3.0 | 80 | 118 | 0.22 | 19 |
| 1062641 | 2.9 | 68 | 163 | 0.27 | 21 |
| 1063268 | 3.1 | 40 | 85 | 0.45 | 20 |
| 1063649 | 3.1 | 29 | 63 | 0.23 | 20 |
| 1063734 | 3.0 | 131 | 257 | 0.23 | 19 |
| 1064096 | 3.0 | 31 | 122 | 0.19 | 23 |

Body Weights

Body weights of hu-PBMC-NSG mice were measured on the day the mice were sacrificed, and the average body weight for each group is presented in the Table below. Modified oligonucleotides that caused any changes in organ weights outside the expected range for modified oligonucleotides were excluded from further studies.

TABLE 96

Body and organ weights (in grams)

| ION NO. | Body Weight (g) |
|---|---|
| PBS | 21 |
| 549148 | 21 |
| 1062413 | 22 |
| 1062428 | 21 |
| 1062641 | 22 |
| 1063268 | 23 |
| 1063649 | 22 |
| 1063734 | 22 |
| 1064096 | 20 |

RNA Analysis

Splenocytes and lymph nodes were extracted for RNA analysis. Splenocytes were isolated from the spleens by mechanical disruption in tissue dissociation tubes (Mitelnyi) on gentleMACS dissociator (Mitelnyi). Primer probe sets RTS35925 described above and RTS35988 (forward sequence, CAAATGGTGTCTGCAAGTGG, designated herein as SEQ ID NO: 3248; reverse sequence, CTCTGGAGGAGACATGTGC, designated herein as SEQ ID NO: 3249; probe sequence, CCTGGCAGTGCITGAGGAAGTCC, designated herein as SEQ ID NO: 3250) were used to measure human Foxp3 RNA levels in separate PCRs. Results are presented as percent change of RNA, relative to PBS control, normalized to either human GAPDH and human CD4. Human GAPDH was amplified using primer probe set RTS 104 (forward sequence, GAAGGTGAAGGTCGGAGTC, designated herein as SEQ ID NO: 3251; reverse sequence, GAAGATGGTGATGGGATITC, designated herein as SEQ ID NO: 3252; probe sequence, CAAGCTCCCGTCTCAGCC, designated herein as SEQ ID NO: 3253). Human CD4 was amplified using ABI primer probe set Hs01058407_m 1.

As presented in the table below, treatment with Ionis modified oligonucleotides resulted in reduction of Foxp3 RNA in comparison to the PBS control. Results are presented in the tables below as percent control of the amount of Foxp3 mRNA relative to PBS control (% control).

TABLE 97

Modified oligonucleotide mediated inhibition of human Foxp3 RNA expression in huPBMC model

| | Splenocytes | | | | Lymph Node | | | |
|---|---|---|---|---|---|---|---|---|
| | Normalized to GAPDH | | Normalized to CD4 | | Normalized to GAPDH | | Normalized to CD4 | |
| ION No. | Foxp3 Levels (RTS35925) % control | Foxp3 Levels (RTS35988) % control | Foxp3 Levels (RTS35925) % control | Foxp3 Levels (RTS35988) % control | Foxp3 Levels (RTS35925) % control | Foxp3 Levels (RTS35988) % control | Foxp3 Levels (RTS35925) % control | Foxp3 Levels (RTS35988) % control |
| PBS | 100 | 100 | 100 | 100 | 100 | 100 | 100 | 100 |
| 549148 | 79 | 87 | 84 | 93 | 91 | 91 | 107 | 102 |
| 1062413 | 34 | 42 | 55 | 69 | 86 | 82 | 91 | 89 |
| 1062428 | 65 | 73 | 80 | 96 | 60 | 58 | 89 | 89 |
| 1062641 | 31 | 39 | 52 | 64 | 36 | 38 | 70 | 70 |
| 1063268 | 61 | 75 | 56 | 70 | 60 | 55 | 97 | 89 |
| 1063649 | 55 | 68 | 64 | 80 | 58 | 60 | 97 | 97 |
| 1063734 | 34 | 43 | 55 | 66 | 82 | 74 | 106 | 94 |
| 1064096 | 65 | 79 | 63 | 77 | 83 | 79 | 107 | 93 |

Flow Cytometry

Foxp3 protein levels were measured in regulatory T-cells using flow cytometry. After incubation with modified oligonucleotides, CD4$^+$ T-cells were stained with fluorescently-labeled CD3, CD4, Helios and FOXP3 antibodies (Biolegend) using TrueNuclear Transcription Factor Buffer Set (Biolegend). Regulatory T-cells were gated as CD3$^+$ CD4$^+$Helios$^+$ cells and Foxp3 protein levels were quantified using median fluorescent intensity of Foxp3 antibody stain.

TABLE 98

Modified oligonucleotide mediated inhibition of human Foxp3 protein levels in huPBMC model

| ION NO. | % control Foxp3 protein |
|---|---|
| PBS | 100 |
| 549148 | 74 |
| 1062413 | 63 |
| 1062428 | 59 |
| 1062641 | 48 |
| 1063268 | 53 |
| 1063649 | 22 |
| 1063734 | 33 |
| 1064096 | 54 |

Example 14: Dose-Dependent Inhibition of Human Foxp3 mRNA and Protein Levels in CD4 T-Cells Derived from Hu-PBMC-NSG Mice by Modified Oligonucleotide Human CD4$^+$ T-cells were isolated from splenocytes of humanized PBMC mice (hu-PBMC-NSG, Jackson Laboratory) through a combination of initial purification using the Human Easysep CD4 T-cell purification kit (Stemcell Technologies), followed by a negative selection using the Mouse Easysep CD4 T-cell purification kit (Stemcell Technologies) to enrich the human population only. Purified human CD4$^+$ T-cells were cultured in Immunocult-XT T-cell expansion media (Stemcell Technologies) supplemented with 30 ng/mL of human recombinant IL-2 (Stemcell Technologies). CD4$^+$ T-cells were treated ex-vivo with modified oligonucleotides by free uptake in a dose response study for 72 hours. Cells were activated for 24h in the presence of Imunocult human CD3/CD28/CD2 T-cell activator (Stemcell Technologies). Cells were harvested and evaluated for changes in the levels of Foxp3 mRNA.

Primer probe set RTS35988 was used to measure human Foxp3 RNA levels. Foxp3 RNA levels are normalized to either human GAPDH or to human CD4. Human GAPDH was amplified using primer probe set RTS104. Human CD4 was amplified using ABI primer probe set Hs01058407_m1. Results are presented in the tables below as percent control of the amount of Foxp3 mRNA relative to PBS control (%/control).

Foxp3 protein levels were measured in regulatory T-cells using flow cytometry. After incubation with modified oligonucleotides, CD4$^+$ T-cells were stained with fluorescently-labeled CD3, CD4, Helios and FOXP3 antibodies (Biolegend) using TrueNuclear Transcription Factor Buffer Set (Biolegend). Regulatory T-cells were gated as CD3$^+$ CD4$^+$Helios$^+$ cells and Foxp3 protein levels were quantified using median fluorescent intensity of Foxp3 antibody stain.

TABLE 99

Modified oligonucleotide mediated inhibition of human Foxp3 RNA expression in CD4 T-cells from huPBMC model (normalized to GAPDH)

| | % control - RTS35925 normalized to GAPDH | | | | | |
|---|---|---|---|---|---|---|
| ION No. | 10 μM | 2.5 μM | 0.63 μM | 0.16 μM | 0.04 μM | IC50 (μM) |
| 1062428 | 47 | 48 | 48 | 75 | 85 | 2.6 |
| 1062641 | 57 | 65 | 71 | 75 | 99 | 16.9 |
| 1062835 | 59 | 65 | 70 | 85 | 80 | 46.3 |
| 1062937 | 39 | 46 | 61 | 62 | 80 | 1.8 |
| 1063268 | 38 | 46 | 60 | 66 | 86 | 1.9 |
| 1063649 | 50 | 68 | 77 | 91 | 113 | 8.7 |
| 1063655 | 33 | 35 | 60 | 80 | 103 | 1.5 |
| 1063734 | 13 | 24 | 34 | 54 | 86 | 0.3 |
| 1064096 | 54 | 52 | 72 | 79 | 91 | 8.4 |
| 1064313 | 61 | 70 | 77 | 84 | 102 | 24.7 |
| 792169 | 138 | 87 | 87 | 71 | 81 | >10 |

TABLE 100

Modified oligonucleotide mediated inhibition of human Foxp3 RNA expression in CD4 T-cells from huPBMC model (normalized to CD4)

| | % control - RTS35925 normalized to CD4 | | | | | |
|---|---|---|---|---|---|---|
| ION No. | 10 μM | 2.5 μM | 0.63 μM | 0.16 μM | 0.04 μM | IC50 (μM) |
| 1062428 | 48 | 47 | 46 | 70 | 90 | 2.3 |
| 1062641 | 50 | 60 | 64 | 70 | 86 | 8.5 |
| 1062835 | 59 | 62 | 66 | 79 | 79 | 40.6 |
| 1062937 | 41 | 44 | 55 | 61 | 74 | 1.5 |
| 1063268 | 41 | 45 | 61 | 66 | 82 | 2.2 |
| 1063649 | 55 | 62 | 75 | 87 | 110 | 9.9 |
| 1063655 | 34 | 37 | 60 | 75 | 97 | 1.5 |
| 1063734 | 13 | 23 | 33 | 51 | 82 | 0.2 |
| 1064096 | 46 | 49 | 65 | 75 | 90 | 3.8 |
| 1064313 | 59 | 65 | 73 | 79 | 97 | 20.6 |
| 792169 | 139 | 90 | 87 | 73 | 80 | >10 |

TABLE 101

Dose-dependent inhibition of human Foxp3 protein expression by modified oligonucleotides in regulatory T-cells

| ION No. | % control | | | | | IC$_{50}$ (μM) |
|---|---|---|---|---|---|---|
| | 10 μM | 2.5 μM | 0.63 μM | 0.16 μM | 0.04 μM | |
| 1062428 | 32 | 45 | 53 | 73 | 93 | 1.4 |
| 1062641 | 54 | 65 | 74 | 91 | 102 | 11.0 |
| 1062835 | 60 | 69 | 77 | 89 | 100 | 20.9 |
| 1062937 | 44 | 46 | 59 | 72 | 88 | 2.6 |
| 1063268 | 46 | 57 | 69 | 87 | 100 | 5.5 |
| 1063649 | 33 | 43 | 58 | 81 | 101 | 1.8 |
| 1063655 | 26 | 31 | 49 | 72 | 90 | 0.8 |
| 1063734 | 12 | 16 | 28 | 50 | 80 | 0.2 |
| 1064096 | 31 | 40 | 58 | 78 | 92 | 1.5 |
| 1064313 | 50 | 57 | 68 | 84 | 98 | 6.5 |
| 792169 | 105 | 94 | 97 | 106 | 107 | >10 |

Example 15: Dose-Dependent Inhibition of Human Foxp3 in SUP-M2 Cells by Modified Oligonucleotide Modified oligonucleotides were tested for their effect on Foxp3 mRNA level in vitro in SUP-M2 cells. Cultured SUP-M2 cells at a density of 35,000 cells per mL, were transfected using electroporation with modified oligonucleotides diluted to concentrations of 10 μM, 2.5 μM, 0.63 μM, 0.16 μM and 0.04 μM. After a treatment period of approximately 48 hours, RNA was isolated from the cells and Foxp3 mRNA levels were measured by quantitative real-time RTPCR. Human primer probe sets RTS35925 and RTS35988 were both used to measure mRNA levels in separate RTPCR reactions. Foxp3 mRNA levels were adjusted according to total RNA content, as measured by RIBOGREEN®, as well as adjusted to GAPDH levels measured by human primer-probe set RTS 104. Results are presented in the tables below as percent control of the amount of Foxp3 mRNA relative to untreated control cells (% UTC).

TABLE 102

Dose-dependent inhibition of human Foxp3 mRNA expression by modified oligonucleotides in SUP-M2 cells

| ION No. | % UTC - RTS35925 normalized to GAPDH | | | | | IC$_{50}$ (μM) |
|---|---|---|---|---|---|---|
| | 10 μM | 2.5 μM | 0.63 μM | 0.16 μM | 0.04 μM | |
| 1062428 | 7 | 18 | 48 | 84 | 95 | 0.6 |
| 1062641 | 10 | 30 | 61 | 92 | 101 | 0.9 |
| 1062835 | 17 | 42 | 77 | 94 | 126 | >10 |
| 1062937 | 24 | 60 | 112 | 144 | 134 | 1.6 |
| 1063268 | 9 | 24 | 52 | 71 | 84 | 0.9 |
| 937101 | 43 | 50 | 58 | 64 | 69 | 1.8 |
| 549144 | 52 | 45 | 56 | 74 | 82 | 0.3 |
| 1063649 | 3 | 11 | 26 | 85 | 102 | 0.3 |
| 1063655 | 10 | 24 | 61 | 98 | 119 | 0.5 |
| 1063734 | 2 | 12 | 33 | 74 | 124 | 0.1 |
| 1064096 | 4 | 19 | 48 | 95 | 110 | 0.5 |
| 1064313 | 20 | 44 | 83 | 90 | 112 | 2.7 |
| 937101 | 49 | 70 | 69 | 72 | 83 | >10 |
| 549144 | 52 | 66 | 79 | 83 | 94 | >10 |

TABLE 103

Dose-dependent inhibition of human Foxp3 mRNA expression by modified oligonucleotides in SUP-M2 cells

| ION No. | % UTC - RTS35925 normalized to Ribogreen | | | | | IC$_{50}$ (μM) |
|---|---|---|---|---|---|---|
| | 10 μM | 2.5 μM | 0.63 μM | 0.16 μM | 0.04 μM | |
| 1062428 | 9 | 22 | 47 | 81 | 91 | 0.7 |
| 1062641 | 15 | 42 | 71 | 94 | 108 | >10 |
| 1062835 | 25 | 49 | 89 | 102 | 125 | 2.8 |
| 1062937 | 19 | 45 | 72 | 95 | 97 | >10 |
| 1063268 | 14 | 35 | 70 | 85 | 110 | >10 |
| 937101 | 67 | 83 | 95 | 110 | 120 | >10 |
| 549144 | 68 | 57 | 69 | 81 | 91 | >10 |
| 1063649 | 4 | 13 | 30 | 82 | 88 | 0.4 |
| 1063655 | 13 | 29 | 68 | 102 | 111 | 0.2 |
| 1063734 | 3 | 16 | 39 | 80 | 129 | 0.4 |
| 1064096 | 6 | 21 | 51 | 92 | 99 | 0.8 |
| 1064313 | 25 | 53 | 91 | 93 | 115 | >10 |
| 937101 | 80 | 113 | 107 | 111 | 121 | 1.7 |
| 549144 | 69 | 91 | 101 | 99 | 106 | >10 |

TABLE 104

Dose-dependent inhibition of human Foxp3 mRNA expression by modified oligonucleotides in SUP-M2 cells

| ION No. | % UTC - RTS35988 normalized to GAPDH | | | | | IC$_{50}$ (μM) |
|---|---|---|---|---|---|---|
| | 10 μM | 2.5 μM | 0.63 μM | 0.16 μM | 0.04 μM | |
| 1062428 | 8 | 18 | 56 | 82 | 94 | 0.7 |
| 1062641 | 11 | 30 | 60 | 80 | 97 | 1.1 |
| 1062835 | 18 | 47 | 72 | 99 | 114 | 2.4 |
| 1062937 | 24 | 71 | 102 | 150 | 144 | 2.2 |
| 1063268 | 9 | 33 | 47 | 70 | 82 | >10 |
| 937101 | 49 | 57 | 54 | 62 | 62 | >10 |
| 549144 | 52 | 64 | 73 | 77 | 91 | >10 |
| 1063649 | 3 | 10 | 38 | 76 | 112 | 0.2 |
| 1063655 | 9 | 21 | 46 | 76 | 115 | 0 |
| 1063734 | 4 | 12 | 29 | 72 | 93 | 0.3 |
| 1064096 | 8 | 22 | 53 | 82 | 104 | 0.5 |
| 1064313 | 25 | 49 | 74 | 92 | 104 | 2.3 |
| 937101 | 56 | 59 | 69 | 74 | 72 | 1.2 |
| 549144 | 69 | 71 | 77 | 88 | 93 | 0.4 |

TABLE 105

Dose-dependent inhibition of human Foxp3 mRNA expression by modified oligonucleotides in SUP-M2 cells

| ION No. | % UTC - RTS35988 normalized to Ribogreen | | | | | IC$_{50}$ (μM) |
|---|---|---|---|---|---|---|
| | 10 μM | 2.5 μM | 0.63 μM | 0.16 μM | 0.04 μM | |
| 1062428 | 10 | 23 | 53 | 78 | 91 | 0.7 |
| 1062641 | 17 | 42 | 67 | 82 | 101 | 1.8 |
| 1062835 | 26 | 55 | 84 | 104 | 116 | 1.8 |
| 1062937 | 20 | 54 | 65 | 98 | 106 | 1.8 |
| 1063268 | 14 | 48 | 64 | 90 | 108 | 2.3 |
| 937101 | 77 | 96 | 90 | 109 | 111 | 4.9 |
| 549144 | 67 | 84 | 93 | 90 | 102 | >10 |
| 1063649 | 4 | 12 | 43 | 76 | 97 | 0.2 |
| 1063655 | 12 | 26 | 51 | 81 | 110 | 0 |
| 1063734 | 5 | 16 | 35 | 78 | 97 | 0.3 |
| 1064096 | 10 | 26 | 58 | 82 | 98 | 0.5 |
| 1064313 | 32 | 60 | 82 | 96 | 107 | 2.3 |
| 937101 | 93 | 98 | 109 | 116 | 108 | 1.2 |
| 549144 | 93 | 99 | 100 | 106 | 106 | 0.4 |

SEQUENCE LISTING (3247 sequences)

SEQ ID NO: 1 - DNA, 2397 bp, Homo sapiens
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctgcccacactgcccctagtcatggtggcaccctccggggcacggctgggccccttgccccacttacaggcactcctccaggacaggccacatttcatgcaccagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccacaaaaaaaaaaaaaaaa

SEQ ID NO: 2 - DNA, 14679 bp, Homo sapiens
tctctttccctggcatttcccatccacacatagagcttcagattctctttctttccccagagaccctcaaatatcctctcactcacagaatggtgtctctgcctgcctcgggttggccctgtgatttattttagttcttttcccttgttttttttttttcaaactctatacacttttgttttaaaaactgtggtttctcatgagccctattatctcattgatacctctcacctctgtggtgaggggaagaaatcatattttcagatgactcgtaaagggcaaagaaaaaaacccaaaatttcaaaatttccgtttaagtctcataatcaagaaaaggagaaacacagagagagagaaaaaaaaaactatgagaacccccccccaccccgtgattatcagcgcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaaggtgagtgtccctgctctcccctaccagatgtgggccccattggaggagatggcagggaggtaggcacggcgggggggtcaggggccctctggtacagtgggatgtacccagctaccgtgattccagccaggtaaggtctttaaaaaaataataatagaataaatggcagaagacttaaaggtgaagtacttaatgcatgggcaggggcaaaaataaatgaattcatcaattgatacgtagatggataggatttttaaaatatgtcagctgccagtctttatggatttcagagctttgaacaacttgaaatgctgtccaggtgcaactgaaaatttcaactgcatctctctcatctctttgtctcttagctcttgatgcctctcatccttctctgtctctctgctcaccctgtcttgctcttttacatgtttctctgcctctctttctcccgccatctgtctgtcgctacactcagactctctttccccgcatctctcctggcctctgaccatctcccctatctctgtctcctccatcttgaccacactccatcgatctcctttcctccatctctcccgctctcttttcttgccttcccccacctgccttcccagccagcatccagcctagagctttgtacacagctggcgtttaataatagtaatgtcgccgaggacctttacattttatgagagtgagcatcagttctgttcaccctagtagcaggaggattgcaaggtgccggggcaagctgagcacttaactgaactttgcttgtatcgctttagaggagacccttggggcgggggggcagggagcacttcacaccattgtcaaccgtagtttagctgtgtggacctaccccaggactgcatgtgtgtgaccagagtccatattcaggaagcaaacaggttgttcagggctggggtgagctcgattctgcaggcttagcacagcgtttggcacaaagtaagtgctcacgaagtgttagctattagtatttctgtaaccaaattagaatcatgctatatattggttttgttcctgctttattcaattaacagtagtgtttttgaagcttactaaaaattgtttgaacacatgatctttcatgatggacaagactgtcctcacatcagcatgaactttgattgatttgaccaagtgccgattgttggacattccggttgtttctcgtttttttctataaacatccctgactgcttccttggattcctgaaaagggagttgctggggcaaagggggcgtgcatttttaaagtttatgaccctctctgctaattctccttccaaaaggttgtcctattttatgctccctctacttaagctaaccctaggtgagtattattatgttttaattatttcccaacatgacaggtaagaaaaacacattatcacattgttgaaatttgcatcttgtgattacttttactattcattggccattcatgcttttttttttttttttttttggttgtctggtcatgtccttactcctaatagggtgttcatcttatttttcccttattgatttgccacagctctttatttggaatggttattaacctttcatcagccattacatatatagcaaatattttccccaattcatcatttgctttttttctatttgtttatggtgttttttgtgatgcttatgatggttttatacagtcaaataggttagtctttttttctgtggcttctgtctctggttttgtgcttagaaagtcctttcctacttgaaaatgagataaatgttcacctatgttggcttctagtctcttttatggcttcattttttccatttactatagaggttaagagtgtgggtactggagccagactgtctgggacaaacccagcgtcaccccaagccctatgtgtgatttttagccaggcacttaacctctccatacctccatttcctcatatgtactgcaatggttataatagtaccttcctcaggagtctttgtttagattaaaatttttaaccacagtaaatacttagcacaaggcctgacacacaataaacccaagatcagcattaggtgttaaaacttatatcttgaatggatctgggcattttagggtatatgatgatggtgacatttcaaactgggcagggaggggttgttgggataatggactgactattcactcaataactttatcttctccctaattatctcagacacatttgttaaaccatactccatggtcctccagtttgaaatgccacattcatcacaaattcagttctctccatatgtgggtccatgtccaagctttctattctgttctcttccccagtatctgttcttataccagggccacactgttttgctgattgttgctttgcaatacaattcaatacccagccatgggtgtccctggcaccttgcccttctttattcttgattatttcaggcagcatcagttgaaccagccagagaccagcaaatgttcttatttgaggcaatcctcctctcgcacacatgcactctggctctccatgcatgtgtccatttctctcaatgtctctcactatctcttgttctctcttgctcgctctttgtgtgtgtctctttgtctctatgtatccctatctctcagccagtcccctggatagaggggcaattgtcaacttgaagccctgcagacacctaatgacttaaccagacagcgtagaagggccctggcccttgtctactccacgcctctccgtgctcagtgtagaagggcaaattgaagaccagagatctcagggcctcaccgaaatgcagcggcagagttgaaatccaagcctagatctcaggactctaggtgggaccctggttctggctctctccccaactgaaggcctcagtttacccctcagcacccagaagggggaaggggaacctgggctaccattcccccttctgccttctcacacgttggaccccaacttcccacaggttggacgatccacgatcacagtgtggggcccagcctcacaagagctgggctaggtgaggccccggactccataggtcaggaggcctagttggccagagcgtggtgatgatggaggcatgtcagtcagtcaggctgtgtgtccccagagctggtgctggtccccgaaaaccttgattgtggggcccctctagagagtctgatgatgggctctgtattggcgaaggctgaggcttttccagctccccccatgaggcccagaccaaaggcacaccagcctcaacctcctcctccccctgttgccatctctggcggagtggccatgtatttgggaacgttgttccagagtggacagggagactgaggccctagggaggctggctctgtttccaggcctggtaggcaagaggccctatgaagcagcaagctgcctgactttcagatggttccaaggagtttggacaccagggacactggcctacacatactgagactttgggaccgtagaccccacagtctgtggttttgagattctaggatcctttaaatctaagaaatgctgttctatgattctgaggtcctggtgttatactatttgaagaccccaggggtcccagtatctgtggagcctgcctggcactctcagagcttcaaacctgggtcctctccacaacccaagaagggccaggtcttcagagctaggggcttgtcatagtggccagatggacatcacctaccacatccaccagcacccatgtcaccccacctgggccaagcctgctgcaggacagggcagccagttctcggaacgaaacctgtggggtggggtatctgccctcttctcttcctccgtggtgtcgatgaagcccggcgcatccggccgccatgacgtcaatggcggaaaaatctgggcaagtcgggggctgtgacaacagggcccagatgcagaccccgatatgaaaacataatctgtgtcccagaaacatcccccattcagcttctgagaaacccagtcagaaagggacgtcccaacagacagtgcaggaagccggctgcccagcccggccctctaggtcctctacccccagacagatcatctccatgtccctgtctgagaatgtatctatgctttgctgagtcaggccatcccacatgtgtttggggagaattcttagctctggccaagtgtccaggcagcttcagaagtgaccacaggccagccacatgggccaggccagagtggtggaaaacatccatttgcaccgaaatcggtattagtttgttctggctgctataacaaagtaccacaactgagtggcttcagcaacagaaattgatcatctcacagttctggaggccagagtccaagatcaaggtgttgccagggttggttccttctgggggccataagggagaagctgctccaggcctctcccccagcttctggtggttgctggcaatctttgttatttcttggcttgaaggagcatcaccccatctctggcttcattcattcactcaccttctcatctcaccagtgctctcccaggcccttgttcggagcctccacagacccacactcctgtttctcacgcagtaatgttctaagcccccaggagactaagaacttaatacctggattctcacactcatctccctcagcaccacagctctgacaaccacccccaggaggtgacagcaaagaaaggaaggagcaactgctcccccagaacccttctatactcccccgggctgctctcagcagctgtgtgcccaactcagtgctgtgaggtggaacggggagatggagacacacacacacacacaccagagagtttataaaatgtgcacacggaaacacttcctaaagaaagaagtggagttctcaagtcactatgggactacggaactcggcatctgagcatccccttctgtataatggggttggctgggcagtcccttccagctctggcttcctctcagaccaggattataggatcctgaaaagccagtgcttccctcagggagtggaaggttctggggctcagcagggggcccggagccattgtggagggctttcaaggtgaggacaatagaagagcaggtcttgcgtggcttggacagggaaagaggagaaggagtgggcatttgaggcagggggtgtagcatgagccaggcttgagggccagaaattggggtgaactctgatgggggctgggtagagaagcttctacaggccccagctcaagagaccccatctctcctcctctctgtcacttgccatgctggatccgtgcatgatcacactcctggactcgcctccttgccctgagatccagacccccgtattcagctgccccctcagctcctccactcacatatttaatgccagactcttcatgtctatctacacctgcacttttgcacccaatccaactccccgccatgtcccccatctcaggtaatgtcagctcggtccttccagctgctcaagctaaaacccatgtcactttgactctccctcttgcccactacatccaagctgctagcactgctcctgatccagcttcagattaagtctcagaatctacccacttctcgccttctccactgccaccagcccattctgtgccagcatcatcacttgccaggactgttacaatagcctcctcactagccccactcacagcagccagatgaatcttttgagtccatgcctagtcactggggcaaaataggactccgaggagaaagtccgagaccagctccggcaagatgagcaaacacagcctgtgcagggtgcagggagggctagaggcctgaggcttgaaacagctctcaagtggagggggaaacaaccattgccctcatagaggacacatccacaccagggctgtgctagcgtgggcaggcaagccaggtgctggacctctgcacgtggggcatgtgtgggtatgtacatgtacctgtgttcttggtgtgtgtgtgtgtgtgtgtgtgtgtgtgtgtctagagctggggtgcaactatggggcccctcgggacatgtcccagccaatgcctgctttgaccagaggagtgtccacgtggctcaggtggtcgagtatctcataccgccctagcacacgtgtgactcctttcccctattgtctacgcagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcaggtgaggccctgggcccaggatggggcaggcagggtggggtacctggacctacaggtgccgacctttactgtggcactgggcgggaggggggctggctggggcacaggaagtggtttctgggtcccaggcaagtctgtgacttatgcagatgttgcagggccaagaaaatccccacctgccaggcctcagagattggaggctctccccgacctcccaatccctgtctcaggagaggaggaggccgtattgtagtcccatgagcatagctatgtgtccccatccccatgtgacaagagaagaggactggggccaagtaggtgaggtgacagggctgaggccagctctgcaacttattagctgtttgatctttaaaaagttactcgatctccatgagcctcagtttccatacgtgtaaaagggggatgatcatagcatctaccatgtgggcttgcagtgcagagtatttgaattagacacagaacagtgaggatcaggatggcctctcacccacctgcctttctgcccagctgcccacactgcccctagtcatggtggcaccctccggggcacggctgggccccttgccccacttacaggcactcctccaggacaggccacatttcatgcaccaggtatggacggtgaatgggcagggaggagggagcaggtgggagaactgtggggaggggccccgagtcaggctgaaccacagcccacatgtgccccccagctctcaacggtggatgcccacgcccggacccctgtgctgcaggtgcaccccctggagagcccagccatgatcagcctcacaccacccaccaccgccactggggtcttctccctcaaggcccggcctggcctcccacctggtaacacctcagcccgtaccccatggcttcacagaacccccaagtccccagatccttggctgtgagcagtgtaggctattctgaattgcagtactctgggggtcaaaggtgtcaggtctcagaggcttggaaactccaccctccaaaaaacgtcaggtgcagaaccttaaagatgcagaatgtcaaaatcacaaaaccacagagctttacaaagctagtcaaaatgtcagcacctgcgaatggccgtctttaagcttctctgccagaagcctgggactttggggacagcagagccccctgggagtcagggttttcgaggctcaggagggtgggaagctcaaaatgagaggccttgtgggccaagctccagagcccagcccacagcctccataggtgccctgtccccacccacagggatcaacgtggccagcctggaatgggtgtccagggagccggcactgctctgcaccttcccaaatcccagtgcacccaggaaggacaggtcagtggacagggctgggaaggatcctcgccctcctatcccctcccctgacaccctctgtccccccagcaccctttcggctgtgccccagagctcctacccactgctggcaaatggtgtctgcaagtggcccggatgtgagaaggtcttcgaagagccagaggacttcctcaagtgagtggcccaggcctgtgccagtctaccggccctggcttgtggggagaggtctagggtgcagatctcagctcaggcttcatcccaataagtagtaagatgcaagagctaaactctgagactgtgggttcaaatcccagctccatccctgactggctgtgtgaccttggacaaattacttagcttctctcgacctcagttttctcgtatgtataataagaaacgtttgtgctgttatttacccccattttacagacaaggagactgaggccaaagaggttaagtgtcttgatcaaaatctcccagttcctgagtgacagagctgggatttgaacccatgtagccaggctctagaatctgcactcctgctttgccctgctactcctcatgccaacatgccagccttattccactgttcccaaagttctagctcctctagatggctgctgctgcctcccctcagtccccccatatgtctctctctctctctctctctctctctctctctctctctctctctctctctttctctctctctcacacacacacacacacaaatacacaccacactacacacaacccttagcagcaaccccacatgtcctgtcctccttgcagccaggcctttgcacaggccgtccctccacccagaatgctttgcccactctcacctccctggcccattctcaactcaccacacttccaacattatctccagcactctggccaggctcaagtggtgagttcaggcctgacatgcagtaggtgctgaggggcatgtgttaagggaacgaggggtgtgagagggagactgaggtagagaggggaggggagctggggctcagaggagagaactcccagagggtctgggccctccccattcagagcattgagccagaccaggcctgtcgtggtcacctgcatggaatcttctccctacttaggcactgccaggcggaccatcttctggatgagaagggcagggcacaatgtctcctccagagagagatggtacagtctctggagcagcaggtaatgccagggcggtggagggtaagggatagggatagtgcgcaaaaccttctgtccaccatgtgccagaaaccaagttcacctgggacgagggctggtataaaggaaggaagaggagcgggcactcccagggaagaccgtagcctgggcaaagatgtggcagagaagggccaggctgaggcctcatgtttgtgccatttcacagctggtgctggagaaggagaagctgagtgccatgcaggcccacctggctgggaaaatggcactgaccaaggcttcatctgtggtgagcgaccccaggactggtggtggcagactcagactgctggggggcagggaggaggtctgcacggtgcagggaacctaacctcacattcaggtcctgagagctaggggcccctgtccccagctccaaacatgcccagacctggaaatctgtccccttctacttacaaaccctctgaccccggctgggcgtggtggctcacgcctgtaatcccagcactttgggaggccgaggcgggtggatcacgaggtcaggagttcaagaccagcctcgccaagatggtgaaaccctgtgtctactaaaagtacaaaaaattagccaggcgtggtggcaggtgtctgtagtcccaactacttgggaggctgaggcagagaattgcttgaacctgggaggcggagtttgcagtgagctgagatcataccactgcactccagcctaggcgacagatcaagactccgtctcaagaaaaaaaaaaaaaaaaaaccctctgactctaagatccccaaacactgtgatcctgagttgttaaagcaaatgcaaatagccagacttgccagatgcaggctgtgtgccagcaggaccagctatgtaacctgcagggccccttgttcagatttcaagatggcgaccacagagcattaaacaaagcacagggtgccacataaccacataggtcacacgcccatgaagccagccctggaggccaggcactgtttctgagcgctttgctggtggtaatttatttctcatgatgcgaatgtacagatgaggaatattgaggccaggggggtttaggtgactttcccaaggtcacagttgggtggtaaagagccctattcaaccccagttcatggtcccagcatcagtggccacatacgacatccgcacctgtgctctaataaatacggctcatgctgttttgtgggattccacctcagactggaatttagaagagggcgtccttgctttgaaaaacactgatttaaaaataaagtggagccaggcgcagtggctcatgcctgtaatcccagcactttgggaggctgaagcgggtggatcacatgaggtcaggagttcgagaccagcctggctaacatggtgaaaccccatctctaccaaaaatacaaaaattagctgggcgtagtgacgggcacctgtagtcccagctactcgggaggctgaggcagaagacttgcttgaatctgggaggtgggggttgcagtgagccgagattgcaccactgcactccagcctgggcgacagagcaagactcagtatcaaaaaaaataaaaaacataaaatagaaagtaaaaagtgggaagtttaagcctctgggtcaccagcctctccccctcacccaggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccaggtaagaatggtccttgcactacacggtgcccccaagctcctaatcctgacaggctctgggtggagggtgcaaaggagctccatgctgccccttcccaccaccaccaccactgcagctgccgccactcagcctttgggaaaatgcatccgctcacaaaagcttcctttcgggatgtccgtggcctgaaagccccccatatggtctcgagtgtcgggcccctagccctgactcccttggggattggggccatgcctcacccactctggactccagctactatattcggccatcagaagggagggaccctgctaagtaattccaggagcacctcctttcctcccctgaccaaggaaaatcggggtggattcgcccgagctcacctatccactgctctccaccaggcctggcctgtgggcttagcagggatcagagaccttgactgtcatcctggctctgccatttaacctcttgcatcctttggtgtgcaagttactccgcttcttttcaacctcggggagaactattttggcagaagtggtgcaaagaataaatgatacaacttatgtcaggtgctcagcaaacagtacctgtgcccgtggacacgggtgttgacggtgagatctcaggcctgtagactcaccttgtagggggaggggacagggagctagctaggaggtcctgcatggggcttgattcatccccaccctctgacagagttcctccacaacatggactacttcaagttccacaacatgcgaccccctttcacctacgccacgctcatccgctgggtaagcagggcagctcggccccaaggaggaggaagacaaagatggggtgggggacctgcctcccaaactcctgtctccctctgagtgccctcagagtgggttcctccattcccaagccccagccccaaggatccccaagccgtgcctcaaatgtgacccctcatgctggcttcaccccaaacctgtccgcaaatccaaacctaaaccaccatccaggccagagcatgccaaattctgaccctaaacctacccctttccagatgtccacctcagccccatacctaaccctctcctggacccataaaatagcctaaagctaaccccatctctgcaccttgccctaaacgtaccccagctcttactctaactccttccccagcctttatgccaacccaaccccatctccttccctggccccaacgtaccccagtatgtcaatacacccccaactgggcaccattcccaacctttccttgtaacacccatttgatccttaacttcatcaccccatcccaactccttcatctcagcctccccaatgccttctcagaaccttcatcctagcgccacacctaaccccaaacctgaacctcacccctacatgataccagatattccccgactgtctctgaactgaaaccctgacctagccccatcctgactgatagcctcactgcaatcatcatcgctgactctgtaatcccattcctgaatccaaactgatcaaattccctgaccctcagcctcactccacaccgaaccccacaactaacctcatccttgccctgagcctaaccacctaaccatgtccctgacacgtaagatactcgataattcaaaccatctctggcttctgacctaaagccaagtcatcccatccctcacccctagaccccccacctgagtccaccccagcctgactcttaacccaccccttccctgacccttaagttggcctggccctttaccccttccaaatccttgaccccacttctgacccttcaccttccccaaccctgaaatgtcacctccacagagaaccccaactccaactccatcccagacctttcacctcacttcagccctagccctgaacaagaccccactcccaacctcagtcctgatcccttacctaatcccagaacaaccatacccacacccatctaaccctgcccaacccgacacttcaccccttttctaaccccatctttgaccccatgcttcaccccacatctagtcctgtccctgattacctgcccctacaattccgcccccatgtcagatggctcggggtaggtcatagcccctctaaaccccaagtttggggaatgtgccccttaccccaccccccaacttccaggccatcctggaggctccagagaagcagcggacactcaatgagatctaccactggttcacacgcatgtttgccttcttcagaaaccatcctgccacctggaaggtgagctcctctgaggtggcggtgactgggatggcctcaagtgccatcgcagctcaaagtgggcaggcctgggtctgggctcataggcacattggggaggaacgggatgtgggttgttggtggtggctgctggcctcagaggttgacgcccacctgctccctgtccccggccttccacagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccct

SEQ ID NO: 3 - DNA, 2292 bp, Homo sapiens
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccacaaaaaaaaaaaaaaaa

SEQ ID NO: 4 - DNA, 26000 bp, Homo sapiens
aagagtgaaatccagaatttgccctgaatcatgccacgctttctagaggaccagtttaaaaaaaaaaaatagaaaaaaataaatgtccctagcatttcttccctggccctgtcactcactagctgagaggctttgagcaagctggctcatctctctgagctacctgtctcccctctactaaatggggataatcatagcacctacacaacacagcatgcacagcaggcctcacggagagaatggatctgatgttcatagcacagaaatcagtaaatgctggccagttatcttttgcagttaccaccatgcttcagttaccttgcccatgtttgctgcattcaatccaaccatgcaaagtgactgtcatttcccttagcagagaaggaaacggaggcaaggccacacagctgatgggcggagccgaatttaggagaggaatccaggaaactgtaggtgtggctccctaaatactgacactagctaacacctgtatgatactactttgagccagactcggttctgagcacctttactcttatcccgtaaagtagatgctataattctgttttacaggtgagggtcctgaggcatggtgtagttaaatgcgttggccaaggtcacaaggccagtaagtggcagcgccaggatttgaacccaggcaatctatgccagaatccacactcttaatgctgtaagaaaaaccatgctgcctgccccctttaaatgaagtctcagattatggtggggctcacaggtgggtgagtgggtacctgcctgcctgctcagttacccaggcacatctgcccaccagaccggagctagacctttctgaaccactcacagcctaaggccttaccagaaccagcagaacccacaaatgtcttactgcagccaggggcttctgaccaagcgtatacatacaaggtccaaaaagcattttcccatttccattcccagtcctcccaggaacagggaaatgtatacattttagggagaatctagtgatcctgggccagacttaggtgaccgcaaaaagaatcaggactagctgctgcccttaaagaactcatagcttgatagaggaaacctagggaaatcttctggggccccctggggtataactgattatttctccctgtccctaaatgatcacaggtggtgtggcaaaaaaacaagggacaaaaacttcaagtccagtacccatctggttctgtctctctgctagagccactgctttcttgtgagagcatgggctcagcccctcgcctccacaggactcaaaagtagattacagcgttaacagtagagtgcacaggcttcaaggtcaggcatgggtgaactggaagagccaggtgccatcactgcctcaaccagtttctccacctctggaatcctggtttcctgctctgtcagaaagagaatctgctctaccccccactggcaaagcccttggtccacactatgtcattgcagttctctccactccagcacactgctgatcattcacaccaagctcatttccaccccaggacctttgcacttgctgtttcctctacctagaacacccttgttccatatatgcacataactgttattcatcatccaggacttagtttaaatgaaacctcctcagaaaagtcctccctgttccttttcctacaaactctcccccacctccccaccgtatctgcataactcttctttatcatcattcgggactcacctcctcaaaggccctccctttaacagcatgtctgacacagtcattccctcccaatctatccccttactcccttcagcagctaactttgtccctatttatcctatctgcttgcttgcttgttttttcaaactgtctcccataggagcctgtatgaatccttgagggtagggtagatgtctgtcttgttcagggctttacagtggaactcaataaatggaggaataaaaccccagttaaaacagtgcctagcacgtgtttgacctccatcactctttgactgactgactcaatgcaccctcctccctgtcctggagagcaggcctgaggggttcctgggccggaatgcttgtcctccatcccagacacagccctgcgttggcggaggtggcgctggctgacattacctgcgcctcaccggcttcatgcagctcttcagctgcctggcctcagcctccacgggaccctggcactcgggctgtggctccagctgcggcagctgctgctgctggggcagcccttcggcatcagtgggtgtgggagcgggtgcgatccggagcaggactgtgtagttgcggccgtggttgttggcccagaaagtgccctcaggggtctcatagcgcaccacgaagtcgaggcgcgccccatcgcccgcgccctcagcaaagggcagctggaaggcaaagcggtcggtgcggccgccgtcgtcgggcgaggaggcggatgcctggccgggacccaggccgagccccggatccaggatgggatctcctgctcctgttcctcccgctcctgcccacggcgggctgcgcgggacgtagcgcgctgggtggtcgcaaaaggaagcccagccgtcgtgtgaggcccgcacgtgcaccgccttctcgaaggagcggttcagcacgcgtaccaacccgcgcagcaccggcgggcggcccccaggcacccacaccccggcacccccggggaccgctccgggaggcggcagcagcgcctccagctccaccatgacgcgccccaagcgctccagacggcccggcgcgggcggcagcgaaaatgtggggaccaggtaaaaccccccgccagcggggacggggcacagcggtgagggctcggggcaagcctcctcttcctcctccccttcatccccatcctcgccatcgtcgtcctcgtcggccccgccgccgccgccgccatcttgcccggccgccgccgccatcttgcccgccccgggcccgccccacggccggtagcggcgcaactgcgccagcggcagccccaaggcctcgtcggcgaacagcaccctccgcggggccaccgccgcctcgaccgaggtgcggggctcacccgcggccggcgaggggggcgcggaatgccgcagcgggggctccacaggggccgtacgcgccatatcggcggcggcggcggcaccgacggcaccggcggcgggaccggcgggggcagggcctgaaggggcgggcagccaatgggaaggccagcgcggaggggtacggctcacgggggcataggcggtgagatgaagacaagtattgcagagggccaatgggcagccatgcacggatgacgtacagcgaattgagagccggagaagcacgcagccaatggggatgcccgggagtgggcggtgtagggggcgggatgatcgaggaatcaatggagaggccggaatgggggtggtgcgaaatccatgatgaagaaaacagaagcagacagctaatgcggaagtctgagcgagagaggcatgtgggcggtgggaaaagtggaatggctacaggcgatgagggcagccgggaacgaacgcagaggcccaaaaagtgggagatcccgcgggttgcgtaggcggtggaacggtagctagagagagagaacagccaatggagagccacgcgtgggatgacgacaatggctgcagcgagccaatggggaggcttgtgagcgtgcactgcggcttcgaaggggtggtgccaaggtggagctagccaatacgaaggctaaaaggagaccaagaggcgggtgtgtagggagccgagccaatggaggtggaggctgaaggcgggagcgaggacgagagctggcggatagccaatgagggagccagggtgaaggcgtagagacctcaaaggacagtactagtatgggatgagccaatgccgaggctagatagtgcagcgggacggagggaggacttggaggcaagatggggaaaaaagcagagccgacgggggcagtgtaggtggtgtgaagggaggcatgagtagccaataaggaggctggagaggaggacgctgtgtagacagagtctgaggtattgggtggccggacagcagaaccatagaacgcaggcagccattaggaaaaatgtgcttctcagggatggggttaccctctccctaaccctccgtgactccccattgccccaggaatacccagagcccctgaaggcctagaccacaccttggtgtgtgaactaggaaagtgaaaatgactgtcctgttgcagttagttacttactgggtcctccctgcccaactacaaccttttcttgagcagtgccacaagccaagaatgcccctgattgttagccgcaagcactctccaggacttgatactattgttgaatgaatggccgaataggaaatttaactttctgaaggattcacttttttaaatttcagctcagcaaacactgacctgactgtgtgctaccagaagttgattgggcatatgggtagcttctgactaatggaatcacaatcaaagccctgtccttcttgcccaacctgacactccacaccccacaggggcctcacctcccttctttctgtccccccatctctgcttctactgttccctctcccaagagtgctgttccttctgctgcttccatctagtaaactcctttcgctctccctttggggtctcaccttctgtgggaactcaactgcagcttttgtccgctgaacacatccattcatacattccttctccatcctgggaagatttactgaacacctactgagtgccaggttctgagcatgctgttatctcattagaacctcacagcatcctaggagggaggtgatccttccagcagcccctctccccaggtctccatgttcaggatgtccatgagttagaaatgaatatgttcagctgcaagtaacagaaaaatcataaaataatgggggcttaagcaagacagaactttatttttttctcacctaaaagttcaagctggcaaatagtccagggactccttcctgcccacctggtttgggcattgtctgtcccgatctggctccaagactctcagtcttcaacaaatccttttggctgtctattaaaaatatttaccaaatccatcctcttctcaccacctccactgccagcactatcaccagtcacctagactactgcagtagccagctccttgctggtcccctgcttccacattcaggccctagaccccattgtacactcagcattcaggggcttcctgttaaatcctaacacggtttgtgtttctcctctgcttgcaaccctgtcatgccttcctcctcactcagcgttgaagccaaagtccttaccatggcctacaaggtcctgcgtggtctaacctccgagtcccctttctgacctcacctccagcttctcttcttgctctctccacactaaccacaccagcccccttgtagaccttgaacaaatcaggtacattcccacctcaggacctttgccctggctgtttcctttggagttcctcagatatctagctggctccctccctcatctccttcaagtctttgtcagaggcccctgtctctggggacttttcctgacccgtttaatcttgcctactcacccccaactcccagccctcccagtctccttcccgagaagccctccatgagagaggatatagtccagtatagaggggaggtagcgacctctacccctctctgccctcctgaccccagcccccattctgcaaggatcttggctttcagcagccgtagcatttccctctcacaccctgggcctgcccaaggggccagctcacattctcggccaccatcctcacttcgtttgcctcctatatctctggccactctctttcatggagtgagtgacagtaagggacagatggtctggggaaggtataaggagaatgcagcccacacctctgatcctgagagagaaaactagcccccttttccaggagggggacaggtgctggggcagggaacaatgcctctgctgatagaactggcctggtttataattacgcaggaggtgtagggaacattccgacccaagtctgcagggagcaaggggttattaactatgggaacatcagtgcaagggatcattaaccttaggaccatcactgcaaggggtcattaaccttggggccatcactagaatcagctccccaggactccttcctgacatgcatgctcctcaccccctcccttgctccctcccacatgccgtgacatctgttaaacacctgctgttcacagggtccctgcaggcctccaagcaggggacctcatcccaccttggtgcctcccctggctgtccaacacacccaagccatttttgggtctcagatgtgtcccaccaactcagaagcctcaaccagcgaaagttttgttttgaactaatggtggggagggttgggtgtttttttttttttttaattgttgttggctgatttttttaaggtctttttttttctattctttttttttttttttcttgtcttcacaaagccaggccatcaggcccattctgggcttttccagaagggtgagtctgagttgaggaaagaggccctcctttttacgagggcttagaaggttgggggaggaaagggggcaaaggggtgaaggggtggatcttggccaccagatttgtaccatgtaaataaaaagccctttccaatttctcttccccaggtctgaagccagtcttgtagagggctggagtggttgttggacgactagaaccctgggctttgcagggtgctgggagctggaagtcttcaccatggcctgtcaggagaagcccctgggggctggtctaccatgctgaccagtggttgaatagagtgcctgctgaggtcaagagatgcagccgccaattcctggacaacctaaaagcctcacaagcttcaagtctccaaggactctccaaatcccaggatctccctgccatcacatcctagaatttaaaacctgagaacatcaagttcaggaaagcttggggatttcaaagcccagcaccaaagaaagcgggacccacactcgccagctctgtgatcttgggcaagttgcttgactacttatacctccgtttccctcatctgtataacaggaatacaataatgatgagatggagctcaaggggccatggtgaggattgaacatgatcacttgtgagacatgttcagcactgtatctgacccatggaaaattcaagataaacatcagctactgagatgatggcggatatttggaatcctaaatccttggaaactggggctttttgaagtaaaagaccccaaaggctgagggcctcagaagcatcaggccatgatgttcctgaaacaagagggtcagggtcccaatgggcctctggggttcatcgtgaggatggatgcattaatattggggacctgctagggaccttcccagtgggacagtggctgggtcagggcactcaagccctaaaacgtgatgaggcgagacttttctctctttcctcattcagtaactgtcagtagattctgggagccagggattctccgactcttcaagtccatgaattttaggggatgacagtgggctctccgctttctcctccatgaagtaacttacatgcccctcaccctctgtgggaggggtgttgcagggggtgcagaactcccctcgccgggtagttcaagcaatggggaccatatcaattccatctatagggaaactgaggcctggagtagggcgaggcctctgggaacccagccctattctgtctctttccctggcatttcccatccacacatagagcttcagattctctttctttccccagagaccctcaaatatcctctcactcacagaatggtgtctctgcctgcctcgggttggccctgtgatttattttagttcttttcccttgttttttttttttcaaactctatacacttttgttttaaaaactgtggtttctcatgagccctattatctcattgatacctctcacctctgtggtgaggggaagaaatcatattttcagatgactcgtaaagggcaaagaaaaaaacccaaaatttcaaaatttccgtttaagtctcataatcaagaaaaggagaaacacagagagagagaaaaaaaaaactatgagaacccctccccaccccgtgattatcagcgcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaaggtgagtgtccctgctctcccctaccagatgtgggccccattggaggagatggcagggaggtaggcacggcgggggggtcaggggccctctggtacagtgggatgtacccagctaccgtgattccagccaggtaaggtctttaaaaaaataatagaataaatggcagaagacttaaaggtgaagtacttaatgcatgggcaggggcaaaaataaatgaattcatcaattgatacgtagatggataggatttttaaaatatgtcagctgccagtctttatggatttcagagctttgaacaacttgaaatgctgtccaggtgcaactgaaaatttcaactgcatctctctcatctctttgtctcttagctcttgatgcctctcatccttctctgtctctctgctcaccctgtcttgctcttttacatgtttctctgcctctctttctcccgccatctgtctgtcgctacactcagactctctttccccgcatctctcctggcctctgaccatctcccctatctctgtctcctccatcttgaccacactccatcgatctcctttcctccatctctcccgctctcttttcttgccttcccccacctgccttcccagccagcatccagcctagagctttgtacacagctggcgtttaataatagtaatgtcgccgaggacctttacattttatgagagtgagcatcagttctgttcaccctagtagcaggaggattgcaaggtgccggggcaagctgagcacttaactgaactttgcttgtatcgctttagaggagacccttggggcgggggggcagggagcacttcacaccattgtcaaccgtagtttagctgtgtggacctaccccaggactgcatgtgtgtgaccagagtccatattcaggaagcaaacaggttgttcagggctggggtgagctcgattctgcaggcttagcacagcgtttggcacaaagtaagtgctcacgaagtgttagctattagtatttctgtaaccaaattagaatcatgctatatattggttttgttcctgctttattcaattaacagtagtgtttttgaagcttactaaaaattgtttgaacacatgatctttcatgatggacaagactgtcctcacatcagcatgaactttgattgatttgaccaagtgccgattgttggacattccggttgtttctcgtttttttctataaacatccctgactgcttccttggattcctgaaaagggagttgctggggcaaagggggcgtgcatttttaaagtttatgaccctctctgctaattctccttccaaaaggttgtcctattttatgctccctctacttaagctaaccctaggtgagtattattatgttttaattatttcccaacatgacaggtaagaaaaacacattatcacattgttgaaatttgcatcttgtgattacttttactattcattggccattcatgcttttttttttttttttttggttgtctggtcatgtccttactcctaatagggtgttcatcttatttttcccttattgatttgccacagctctttatttggaatggttattaacctttcatcagccattacatatatagcaaatattttccccaattcatcatttgctttttttctatttgtttatggtgttttttgtgatgcttatgatggttttatacagtcaaataggttagtctttttttctgtggcttctgtctctggttttgtgcttagaaagtcctttcctacttgaaaatgagataaatgttcacctatgttggcttctagtctcttttatggcttcattttttccatttactatagaggttaagagtgtgggtactggagccagactgtctgggacaaacccagcgtcaccccaagccctatgtgtgatttttagccaggcacttaacctctccatacctccatttcctcatatgtactgcaatggttataatagtaccttcctcaggagtctttgtttagattaaaatttttaaccacagtaaatacttagcacaaggcctgacacacaataaacccaagatcagcattaggtgttaaaacttatatcttgaatggatctgggcattttagggtatatgatgatggtgacatttcaaactgggcagggaggggttgttgggataatggactgactattcactcaataactttatcttctccctaattatctcagacacatttgttaaaccatactccatggtcctccagtttgaaatgccacattcatcacaaattcagttctctccatatgtgggtccatgtccaagctttctattctgttctcttccccagtatctgttcttataccagggccacactgttttgctgattgttgctttgcaatacaattcaatacccagccatgggtgtccctggcaccttgcccttctttattcttgattatttcaggcagcatcagttgaaccagccagagaccagcaaatgttcttatttgaggcaatcctcctctcgcacacatgcactctggctctccatgcatgtgtccatttctctcaatgtctctcactatctcttgttctctcttgctcgctctttgtgtgtgtctctttgtctctatgtatccctatctctcagccagtcccctggatagaggggcaattgtcaacttgaagccctgcagacacctaatgacttaaccagacagcgtagaagggccctggcccttgtctactccacgcctctccgtgctcagtgtagaagggcaaattgaagaccagagatctcagggcctcaccgaaatgcagcggcagagttgaaatccaagcctagatctcaggactctaggtgggaccctggttctggctctctccccaactgcaggcctcagtttacccctcagcacccagaagggggaaggggaacctgggctaccattcccccttctgccttctcacacgttggaccccaacttcccacaggttggacgatccacgatcacagtgtggggcccagcctcacaagagctgggctaggtgaggccccggactccataggtcaggaggcctagttggccagagcgtggtgatgatggaggcatgtcagtcagtcaggctgtgtgtccccagagctggtgctggtccccgaaaaccttgattgtggggcccctctagagagtctgatgatgggctctgtattggcgaaggctgaggcttttccagctccccccatgaggcccagaccaaaggcacaccagcctcaacctcctcctccccctgttgccatctctggcggagtggccatgtatttgggaacgttgttccagagtggacagggagactgaggccctagggaggctggctctgtttccaggcctggtaggcaagaggccctatgaagcagcaagctgcctgactttcagatggttccaaggagtttggacaccagggacactggcctacacatactgagactttgggaccgtagaccccacagtctgtggttttgagattctaggatcctttaaatctaagaaatgctgttctatgattctgaggtcctggtgttatactatttgaagaccccaggggtcccagtatctgtggagcctgcctggcactctcagagcttcaaacctgggtcctctccacaacccaagaagggccaggtcttcagagctaggggcttgtcatagtggccagatggacatcacctaccacatccaccagcacccatgtcaccccacctgggccaagcctgctgcaggacagggcagccagttctcggaacgaaacctgtggggtggggtatctgccctcttctcttcctccgtggtgtcgatgaagcccggcgcatccggccgccatgacgtcaatggcggaaaaatctgggcaagtcgggggctgtgacaacagggcccagatgcagaccccgatatgaaaacataatctgtgtcccagaaacatcccccattcagcttctgagaaacccagtcagaaagggacgtcccaacagacagtgcaggaagccggctgcccagcccggccctctaggtcctctacccccagacagatcatctccatgtccctgtctgagaatgtatctatgctttgctgagtcaggccatcccacatgtgtttggggagaattcttagctctggccaagtgtccaggcagcttcagaagtgaccacaggccagccacatgggccaggccagagtggtggaaaacatccatttgcaccgaaatcggtattagtttgttctggctgctataacaaagtaccacaactgagtggcttcagcaacagaaattgatcatctcacagttctggaggccagagtccaagatcaaggtgttgccagggttggttccttctgggggccataagggagaagctgctccaggcctctcccccagcttctggtggttgctggcaatctttgttatttcttggcttgaaggagcatcaccccatctctggcttcattcattcactcaccttctcatctcaccagtgctctcccaggcccttgttcggagcctccacagacccacactcctgtttctcacgcagtaatgttctaagcccccaggagactaagaacttaatacctggattctcacactcatctccctcagcaccacagctctgacaaccacccccaggaggtgacagcaaagaaaggaaggagcaactgctcccccagaacccttctatactcccccgggctgctctcagcagctgtgtgcccaactcagtgctgtgaggtggaacggggagatggagacacacacacacacacaccagagagtttataaaatgtgcacacggaaacacttcctaaagaaagaagtggagttctcaagtcactatgggactacggaactcggcatctgagcatccccttctgtataatggggttggctgggcagtcccttccagctctggcttcctctcagaccaggattataggatcctgaaaagccagtgcttccctcagggagtggaaggttctggggctcagcagggggcccggagccattgtggagggctttcaaggtgaggacaatagaagagcaggtcttgcgtggcttggacagggaaagaggagaaggagtgggcatttgaggcagggggtgtagcatgagccaggcttgagggccagaaattggggtgaactctgatgggggctgggtagagaagcttctacaggccccagctcaagagaccccatctctcctcctctctgtcacttgccatgctggatccgtgcatgatcacactcctggactcgcctccttgccctgagatccagacccccgtattcagctgccccctcagctcctccactcacatatttaatgccagactcttcatgtctatctacacctgcacttttgcacccaatccaactccccgccatgtcccccatctcaggtaatgtcagctcggtccttccagctgctcaagctaaaacccatgtcactttgactctccctcttgcccactacatccaagctgctagcactgctcctgatccagcttcagattaagtctcagaatctacccacttctcgccttctccactgccaccagcccattctgtgccagcatcatcacttgccaggactgttacaatagcctcctcactagccccactcacagcagccagatgaatcttttgagtccatgcctagtcactggggcaaaataggactccgaggagaaagtccgagaccagctccggcaagatgagcaaacacagcctgtgcagggtgcagggagggctagaggcctgaggcttgaaacagctctcaagtggagggggaaacaaccattgccctcatagaggacacatccacaccagggctgtgctagcgtgggcaggcaagccaggtgctggacctctgcacgtggggcatgtgtgggtatgtacatgtacctgtgttcttggtgtgtgtgtgtgtgtgtgtgtgtgtgtgtgtctagagctggggtgcaactatggggcccctcgggacatgtcccagccaatgcctgctttgaccagaggagtgtccacgtggctcaggtggtcgagtatctcataccgccctagcacacgtgtgactcctttcccctattgtctacgcagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcaggtgaggccctgggcccaggatggggcaggcagggtggggtacctggacctacaggtgccgacctttactgtggcactgggcgggaggggggctggctggggcacaggaagtggtttctgggtcccaggcaagtctgtgacttatgcagatgttgcagggccaagaaaatccccacctgccaggcctcagagattggaggctctccccgacctcccaatccctgtctcaggagaggaggaggccgtattgtagtcccatgagcatagctatgtgtccccatccccatgtgacaagagaagaggactggggccaagtaggtgaggtgacagggctgaggccagctctgcaacttattagctgtttgatctttaaaaagttactcgatctccatgagcctcagtttccatacgtgtaaaagggggatgatcatagcatctaccatgtgggcttgcagtgcagagtatttgaattagacacagaacagtgaggatcaggatggcctctcacccacctgcctttctgcccagctgcccacactgcccctagtcatggtggcaccctccggggcacggctgggccccttgccccacttacaggcactcctccaggacaggccacatttcatgcaccaggtatggacggtgaatgggcagggaggagggagcaggtgggagaactgtggggaggggccccgagtcaggctgaaccacagcccacatgtgccccccagctctcaacggtggatgcccacgcccggacccctgtgctgcaggtgcaccccctggagagcccagccatgatcagcctcacaccacccaccaccgccactggggtcttctccctcaaggcccggcctggcctcccacctggtaacacctcagcccgtaccccatggcttcacagaacccccaagtccccagatccttggctgtgagcagtgtaggctattctgaattgcagtactctgggggtcaaaggtgtcaggtctcagaggcttggaaactccaccctccaaaaaacgtcaggtgcagaaccttaaagatgcagaatgtcaaaatcacaaaaccacagagctttacaaagctagtcaaaatgtcagcacctgcgaatggccgtctttaagcttctctgccagaagcctgggactttggggacagcagagccccctgggagtcagggttttcgaggctcaggagggtgggaagctcaaaatgagaggccttgtgggccaagctccagagcccagcccacagcctccataggtgccctgtccccacccacagggatcaacgtggccagcctggaatgggtgtccagggagccggcactgctctgcaccttcccaaatcccagtgcacccaggaaggacaggtcagtggacagggctgggaaggatcctcgccctcctatcccctcccctgacaccctctgtccccccagcaccctttcggctgtgccccagagctcctacccactgctggcaaatggtgtctgcaagtggcccggatgtgagaaggtcttcgaagagccagaggacttcctcaagtgagtggcccaggcctgtgccagtctaccggccctggcttgtggggagaggtctagggtgcagatctcagctcaggcttcatcccaataagtagtaagatgcaagagctaaactctgagactgtgggttcaaatcccagctccatccctgactggctgtgtgaccttggacaaattacttagcttctctcgacctcagttttctcgtatgtataataagaaacgtttgtgctgttatttacccccattttacagacaaggagactgaggccaaagaggttaagtgtcttgatcaaaatctcccagttcctgagtgacagagctgggatttgaacccatgtagccaggctctagaatctgcactcctgctttgccctgctactcctcatgccaacatgccagccttattccactgttcccaaagttctagctcctctagatggctgctgctgcctcccctcagtccccccatatgtctctctctctctctctctctctctctctctctctctctctctctctctctctctttctctctctctcacacacacacacacacaaatacacaccacactacacacaacccttagcagcaaccccacatgtcctgtcctccttgcagccaggcctttgcacaggccgtccctccacccagaatgctttgcccactctcacctccctggcccattctcaactcaccacacttccaacattatctccagcactctggccaggctcaagtggtgagttcaggcctgacatgcagtaggtgctgaggggcatgtgttaagggaacgaggggtgtgagagggagactgaggtagagaggggaggggagctggggctcagaggagagaactcccagagggtctgggccctccccattcagagcattgagccagaccaggcctgtcgtggtcacctgcatggaatcttctccctacttaggcactgccaggcggaccatcttctggatgagaagggcagggcacaatgtctcctccagagagagatggtacagtctctggagcagcaggtaatgccagggcggtggagggtaagggatagggatagtgcgcaaaaccttctgtccaccatgtgccagaaaccaagttcacctgggacgagggctggtataaaggaaggaagaggagcgggcactcccagggaagaccgtagcctgggcaaagatgtggcagagaagggccaggctgaggcctcatgtttgtgccatttcacagctggtgctggagaaggagaagctgagtgccatgcaggcccacctggctgggaaaatggcactgaccaaggcttcatctgtggtgagcgaccccaggactggtggtggcagactcagactgctggggggcagggaggaggtctgcacggtgcagggaacctaacctcacattcaggtcctgagagctaggggcccctgtccccagctccaaacatgcccagacctggaaatctgtccccttctacttacaaaccctctgaccccggctgggcgtggtggctcacgcctgtaatcccagcactttgggaggccgaggcgggtggatcacgaggtcaggagttcaagaccagcctcgccaagatggtgaaaccctgtgtctactaaaagtacaaaaaattagccaggcgtggtggcaggtgtctgtagtcccaactacttgggaggctgaggcagagaattgcttgaacctgggaggcggagtttgcagtgagctgagatcataccactgcactccagcctaggcgacagatcaagactccgtctcaagaaaaaaaaaaaaaaaaaaccctctgactctaagatccccaaacactgtgatcctgagttgttaaagcaaatgcaaatagccagacttgccagatgcaggctgtgtgccagcaggaccagctatgtaacctgcagggccccttgttcagatttcaagatggcgaccacagagcattaaacaaagcacagggtgccacataaccacataggtcacacgcccatgaagccagccctggaggccaggcactgtttctgagcgctttgctggtggtaatttatttctcatgatgcgaatgtacagatgaggaatattgaggccaggggggtttaggtgactttcccaaggtcacagttgggtggtaaagagccctattcaaccccagttcatggtcccagcatcagtggccacatacgacatccgcacctgtgctctaataaatacggctcatgctgttttgtgggattccacctcagactggaatttagaagagggcgtccttgctttgaaaaacactgatttaaaaataaagtggagccaggcgcagtggctcatgcctgtaatcccagcactttgggaggctgaagcgggtggatcacatgaggtcaggagttcgagaccagcctggctaacatggtgaaaccccatctctaccaaaaatacaaaaattagctgggcgtagtgacgggcacctgtagtcccagctactcgggaggctgaggcagaagacttgcttgaatctgggaggtgggggttgcagtgagccgagattgcaccactgcactccagcctgggcgacagagcaagactcagtatcaaaaaaaataaaaaacataaaatagaaagtaaaaagtgggaagtttaagcctctgggtcaccagcctctccccctcacccaggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccaggtaagaatggtccttgcactacacggtgcccccaagctcctaatcctgacaggctctgggtggagggtgcaaaggagctccatgctgccccttcccaccaccaccaccactgcagctgccgccactcagcctttgggaaaatgcatccgctcacaaaagcttcctttcgggatgtccgtggcctgaaagccccccatatggtctcgagtgtcgggcccctagccctgactcccttggggattggggccatgcctcacccactctggactccagctactatattcggccatcagaagggagggaccctgctaagtaattccaggagcacctcctttcctcccctgaccaaggaaaatcggggtggattcgcccgagctcacctatccactgctctccaccaggcctggcctgtgggcttagcagggatcagagaccttgactgtcatcctggctctgccatttaacctcttgcatcctttggtgtgcaagttactccgcttcttttcaacctcggggagaactattttggcagaagtggtgcaaagaataaatgatacaacttatgtcaggtgctcagcaaacagtacctgtgcccgtggacacgggtgttgacggtgagatctcaggcctgtagactcaccttgtagggggaggggacagggagctagctaggaggtcctgcatggggcttgattcatccccaccctctgacagagttcctccacaacatggactacttcaagttccacaacatgcgaccccctttcacctacgccacgctcatccgctgggtaagcagggcagctcggccccaaggaggaggaagacaaagatggggtgggggacctgcctcccaaactcctgtctccctctgagtgccctcagagtgggttcctccattcccaagccccagccccaaggatccccaagccgtgcctcaaatgtgacccctcatgctggcttcaccccaaacctgtccgcaaatccaaacctaaaccaccatccaggccagagcatgccaaattctgaccctaaacctacccctttccagatgtccacctcagccccatacctaaccctctcctggacccataaaatagcctaaagctaaccccatctctgcaccttgccctaaacgtaccccagctcttactctaactccttccccagcctttatgccaacccaaccccatctccttccctggccccaacgtaccccagtatgtcaatacacccccaactgggcaccattcccaacctttccttgtaacacccatttgatccttaacttcatcaccccatcccaactccttcatctcagcctccccaatgccttctcagaaccttcatcctagcgccacacctaaccccaaacctgaacctcacccctacatgataccagatattccccgactgtctctgaactgaaaccctgacctagccccatcctgactgatagcctcactgcaatcatcatcgctgactctgtaatcccattcctgaatccaaactgatcaaattccctgaccctcagcctcactccacaccgaaccccacaactaacctcatccttgccctgagcctaaccacctaaccatgtccctgacacgtaagatactcgataattcaaaccatctctggcttctgacctaaagccaagtcatcccatccctcacccctagaccccccacctgagtccaccccagcctgactcttaacccaccccttccctgacccttaagttggcctggccctttaccccttccaaatccttgaccccacttctgacccttcaccttccccaaccctgaaatgtcacctccacagagaaccccaactccaactccatcccagacctttcacctcacttcagccctagccctgaacaagaccccactcccaacctcagtcctgatcccttacctaatcccagaacaaccatacccacacccatctaaccctgcccaacccgacacttcaccccttttctaaccccatctttgaccccatgcttcaccccacatctagtcctgtccctgattacctgcccctacaattccgcccccatgtcagatggctcggggtaggtcatagcccctctaaaccccaagtttggggaatgtgccccttaccccaccccccaacttccaggccatcctggaggctccagagaagcagcggacactcaatgagatctaccactggttcacacgcatgtttgccttcttcagaaaccatcctgccacctggaaggtgagctcctctgaggtggcggtgactgggatggcctcaagtgccatcgcagctcaaagtgggcaggcctgggtctgggctcataggcacattggggaggaacgggatgtgggttgttggtggtggctgctggcctcagaggttgacgcccacctgctccctgtccccggccttccacagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccacatgctggactatcaccccatataagggttgcggtcagtgggcaggggtctgggtccaaggccgcagcaggaggaactggacagcggaggaagtagctagggcatgtgcttggccactgcctccagcaccccaaatccctgcctgaggctggggagagacctctgccggcggctcctcaggcctcccggacccggcctaggaggccagcgttctcctggcggagggctcggtagtcctcccggatcttctccaggttgctgagggtcttcttgcccagctctgtctcgatctgaggcaatgtgaacacatgccccctcagcacacacagcccctttcccagctcctgctcaccagcccccatcacagccactctgggcccctcccaccaactccaacagcctgctctgtcccatggccaggcctcgtgtggtgttccctctacccaaagcatccttcgccatgtggcaggattccccctacatctttaagctgaagcctctgcccatggccctgggaggcagacaggagggcccttggggtggaagctggggctcacagtaggccacttgcctgtcccaggtcacaggcactaaggggcagggctgggtgtccagccatcggctgtgtgtggctccacagcctctgtcagcataacctgaggaactgtccccccggcccgccttggctccccatcctgcccccaggcctcacctgctcctcgaggtctcgaacctcccgcatgatggtgcctgtgtcctcgatggtctggatgagctggctgcagttctggggacaacaggagcagaaggcttgcacccagtcccacccacccccagcagccccaccccaggcacatgtctcccctcacctcgtgcagagcagctagatacttataggccttccgaacagcatcgtccttcttggcatcctgaccagacacagggacctcaaaggtatcagtgggctgcccttgaccatctccatgccctaagaaggccaccctctcccaccaccccactagcttcatcctccatgaaacaaagccagccctgggtatcagtgcacctccagcctcgcacagggcctgggtctggaccccagccagccaattagcagatgcacaaggcagcagcccagcctcaccccactcacccccgcccaacctgccccacaccttgaacacaagctcatcagtcaccgcaaacgtccggtccagcttcccagatagggagttgatttccttctgaagctccttcgtatcagacaagatctggcagacaccatggcagccatgagcccctgcctggggcaggctggctagcagtggagggtcctcatgtgtaccagacagggactgtgtcactgtgtcaggggtgactgggatggattgtgtgtgactattctgtgttagagtgtgactggacagctctgcctgagggtgtgaggtccctgtgcggccacactatgcctgacagcccacatgacccaccctccatggccctggcagtgtaccttggtgatctcttccttctgcttccggatgttgcccacgatctccaggatgcgctgggtgtaggccagccgggacacatctctgggcagagtctccagctctgacatctaggcagggatatagcaggcactgccccaggaccatccccccaccctcctaagctacccaggtccctcacacaggccttaccagctgcttatagacctcctccttcctgcgggcctcttcagcagccgcccggacactctggtgcagttcttggatctctgccagccgtcgagaagattccagctgccatgagcccacaggcagaagacagtgagcagagcatagggatggccccctagagagggaccgagcctgccctggcccgcccacagcccagggccccactgcttacctctctgcaatcctgcagctttcggaggtggcggtactcagcgaggagtgggacccggtgcttctcccactgacccgccaagtggatgacccgctgggcactattctccaccacaagctggtgggggatgggtacatgtcacacaggctgggccctccaaccccaccccaccccaccctgcccctctccgcccagctacagccccaaccccacctgcagcttggcaaggttggcagtcccatcgggcagcagctccaccgcgcggctcttcaggcgcagggcctgctcacgctctgctgtactgagcttgctgtgccggcactcagactctgcctggccggtggatacccagtcacatgccacagcccccatggagctccacagatgactgtacacccctgtggcccccacaggcctctctaacagctccacgctggtgccaaggaccccgaggaccccctaatcccctgtccatgcagacccgtgggtaccccacagatgcccacagaccctccgaggacccctcaatcccctgcccatgcagacccgcggtgccccatagatgcccacagaccctcaccctggcctgattctcatagccaccctcaagaggcccacagatccctaatggctcccaggaacccttctgccatgtgcagacctctacagagcacctcttgccccatctagtccctcacaccccgaggccctccttctgacctagcccaacgcgcagcccctcctccgccccttacctgcacaaagctgacgcccagggtcttcatgtcggcctcaacctcctcaatgctgcggttcactccttccagctgctcccgaagggactcgagctcctgttcctgagctgcccacgtgacctgggaggcccaggccagtcagggttggggtgtcaggcccagtagacaagcaagggcctgggacacccccctccaaaccactctgctcacctgttcaggccgccgggaggtggctggcacatctgacacctgagtggcctgggcctggggctcctaaggggagtgacgaggggcatcctggctgccagggaaggcccttcctcacgtggcccagcctcagcctcccctgagaactgcccccagtgcggcatgcatgcccactgaagcaccgatggtggccagactgtgactatgtgggtaaaggcaccatctgcaacctcgggccagagtgcttgctcgtggagaaatctccctgaccctgtcacagctcctacccacctgccccatctctcaagcctcaaatgcccatgagaaggatggggggccctcagagtgaacatcttaggacagaagatatgctcaaaggaaactgcctgaggaaagggggtgttgccccaagaacacccccacacctttgcatggttcccacctatccacattttctccagtcaagtccctaataagctaggggacccctctgggtacccatcccacagtggggcgagggcctgtccagtgggaacacaggaacctgtgtggataaaggtg

SEQ ID NO: 5 - DNA, 1326 bp, Homo sapiens
atgtcccccatctcaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaaggtgagctcctctgaggtggcggtgactgggatggcctcaagtgccatcgcagctcaaagtgggcaggcctgggtctgggctcataggcacattggggaggaacgggatgtgggttgttggtggtggctgctggcctcagaggttgacgcccacctgctccctgtccccggccttccacagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctga

SEQ ID NO: 6 - DNA, 23 bp, Artificial sequence
  Primer
ctacttcaagttccacaacatgc

SEQ ID NO: 7 - DNA, 23 bp, Artificial sequence
  Primer
ccagtggtagatctcattgagtg

SEQ ID NO: 8 - DNA, 23 bp, Artificial sequence
  Probe
cctttcacctacgccacgctcat

SEQ ID NO: 9 - DNA, 16 bp, Artificial sequence
  Synthetic oligonucleotide
ttgaagtagtccatgt

SEQ ID NO: 10 - DNA, 16 bp, Artificial sequence
  Synthetic oligonucleotide
atttttttcgatgagt

SEQ ID NO: 11 - DNA, 16 bp, Artificial sequence
  Synthetic oligonucleotide
ttttataccgagaaga

SEQ ID NO: 12 - DNA, 16 bp, Artificial sequence
  Synthetic oligonucleotide
tgcgatggtggcatgg

SEQ ID NO: 13 - DNA, 16 bp, Artificial sequence
  Synthetic oligonucleotide
ggctgatcatggctgg

SEQ ID NO: 14 - DNA, 16 bp, Artificial sequence
  Synthetic oligonucleotide
caccatttgccagcag

SEQ ID NO: 15 - DNA, 16 bp, Artificial sequence
  Synthetic oligonucleotide
tcggatgatgccacag

SEQ ID NO: 16 - DNA, 16 bp, Artificial sequence
  Synthetic oligonucleotide
aactctgggaatgtgc

SEQ ID NO: 17 - DNA, 16 bp, Artificial sequence
  Synthetic oligonucleotide
tgcggaactccagctc

SEQ ID NO: 18 - DNA, 16 bp, Artificial sequence
  Synthetic oligonucleotide
gtggaaacctcacttc

SEQ ID NO: 19 - DNA, 16 bp, Artificial sequence
  Synthetic oligonucleotide
gaagtaatctgtgcga

SEQ ID NO: 20 - DNA, 16 bp, Artificial sequence
  Synthetic oligonucleotide
gaattctaacaggccg

SEQ ID NO: 21 - DNA, 16 bp, Artificial sequence
  Synthetic oligonucleotide
ggtatttttggcaagg

SEQ ID NO: 22 - DNA, 16 bp, Artificial sequence
  Synthetic oligonucleotide
cggtactgtgggttgg

SEQ ID NO: 23 - DNA, 16 bp, Artificial sequence
  Synthetic oligonucleotide
agggacaggattgtga

SEQ ID NO: 24 - DNA, 16 bp, Artificial sequence
  Synthetic oligonucleotide
ccgaaagggtgctgtc

SEQ ID NO: 25 - DNA, 16 bp, Artificial sequence
  Synthetic oligonucleotide
gtccaagggcaggctt

SEQ ID NO: 26 - DNA, 16 bp, Artificial sequence
  Synthetic oligonucleotide
ggccaggccgggcctt

SEQ ID NO: 27 - DNA, 16 bp, Artificial sequence
  Synthetic oligonucleotide
gaaaaaccacgctgta

SEQ ID NO: 28 - DNA, 16 bp, Artificial sequence
  Synthetic oligonucleotide
ttgcagacaccatttg

SEQ ID NO: 29 - DNA, 16 bp, Artificial sequence
  Synthetic oligonucleotide
tggtagatctcattga

SEQ ID NO: 30 - DNA, 16 bp, Artificial sequence
  Synthetic oligonucleotide
taacaggccgtgtgtg

SEQ ID NO: 31 - DNA, 16 bp, Artificial sequence
  Synthetic oligonucleotide
gttgagtgagggacag

SEQ ID NO: 32 - DNA, 16 bp, Artificial sequence
  Synthetic oligonucleotide
aggcatggatcagggc

SEQ ID NO: 33 - DNA, 16 bp, Artificial sequence
  Synthetic oligonucleotide
ccacgctgtacggtgt

SEQ ID NO: 34 - DNA, 16 bp, Artificial sequence
  Synthetic oligonucleotide
cattgagtgtccgctg

SEQ ID NO: 35 - DNA, 16 bp, Artificial sequence
  Synthetic oligonucleotide
tgcagctgcgatggtg

SEQ ID NO: 36 - DNA, 16 bp, Artificial sequence
  Synthetic oligonucleotide
ggctgcagggctcgac

SEQ ID NO: 37 - DNA, 16 bp, Artificial sequence
  Synthetic oligonucleotide
acgctgtacggtgtgg

SEQ ID NO: 38 - DNA, 16 bp, Artificial sequence
  Synthetic oligonucleotide
agagactgtaccatct

SEQ ID NO: 39 - DNA, 16 bp, Artificial sequence
  Synthetic oligonucleotide
attctaacaggccgtg

SEQ ID NO: 40 - DNA, 16 bp, Artificial sequence
  Synthetic oligonucleotide
tctaacaggccgtgtg

SEQ ID NO: 41 - DNA, 16 bp, Artificial sequence
  Synthetic oligonucleotide
gcagacaccatttgcc

SEQ ID NO: 42 - DNA, 16 bp, Artificial sequence
  Synthetic oligonucleotide
tccaagggcaggcttg

SEQ ID NO: 43 - DNA, 16 bp, Artificial sequence
  Synthetic oligonucleotide
gtctaagctgaggcat

SEQ ID NO: 44 - DNA, 16 bp, Artificial sequence
  Synthetic oligonucleotide
cagaaaaggatcagcc

SEQ ID NO: 45 - DNA, 16 bp, Artificial sequence
  Synthetic oligonucleotide
ccagagactgtaccat

SEQ ID NO: 46 - DNA, 16 bp, Artificial sequence
  Synthetic oligonucleotide
gccgaaagggtgctgg

SEQ ID NO: 47 - DNA, 16 bp, Artificial sequence
  Synthetic oligonucleotide
tgcctatgagcccaga

SEQ ID NO: 48 - DNA, 16 bp, Artificial sequence
  Synthetic oligonucleotide
cgtcaacctctgaggc

SEQ ID NO: 49 - DNA, 16 bp, Artificial sequence
  Synthetic oligonucleotide
gtacatcccactgtac

SEQ ID NO: 50 - DNA, 16 bp, Artificial sequence
  Synthetic oligonucleotide
gacaatggtgtgaagt

SEQ ID NO: 51 - DNA, 16 bp, Artificial sequence
  Synthetic oligonucleotide
ctaatttggttacaga

SEQ ID NO: 52 - DNA, 16 bp, Artificial sequence
  Synthetic oligonucleotide
gttaataaccattcca

SEQ ID NO: 53 - DNA, 16 bp, Artificial sequence
  Synthetic oligonucleotide
ctctatagtaaatgga

SEQ ID NO: 54 - DNA, 16 bp, Artificial sequence
  Synthetic oligonucleotide
taaaatgcccagatcc

SEQ ID NO: 55 - DNA, 16 bp, Artificial sequence
  Synthetic oligonucleotide
tgacaattgcccctct

SEQ ID NO: 56 - DNA, 16 bp, Artificial sequence
  Synthetic oligonucleotide
tgcatttcggtgaggc

SEQ ID NO: 57 - DNA, 16 bp, Artificial sequence
  Synthetic oligonucleotide
agatttaaaggatcct

SEQ ID NO: 58 - DNA, 16 bp, Artificial sequence
  Synthetic oligonucleotide
tgacatgggtgctggt

SEQ ID NO: 59 - DNA, 16 bp, Artificial sequence
  Synthetic oligonucleotide
ggtattaagttcttag

SEQ ID NO: 60 - DNA, 16 bp, Artificial sequence
  Synthetic oligonucleotide
gctcatgctacacccc

SEQ ID NO: 61 - DNA, 16 bp, Artificial sequence
  Synthetic oligonucleotide
tggattgggtgcaaaa

SEQ ID NO: 62 - DNA, 16 bp, Artificial sequence
  Synthetic oligonucleotide
gacttaatctgaagct

SEQ ID NO: 63 - DNA, 16 bp, Artificial sequence
  Synthetic oligonucleotide
cacttgagagctgttt

SEQ ID NO: 64 - DNA, 16 bp, Artificial sequence
  Synthetic oligonucleotide
tgagatactcgaccac

SEQ ID NO: 65 - DNA, 16 bp, Artificial sequence
  Synthetic oligonucleotide
tgctatgatcatcccc

SEQ ID NO: 66 - DNA, 16 bp, Artificial sequence
  Synthetic oligonucleotide
gcacatgtgggctgtg

SEQ ID NO: 67 - DNA, 16 bp, Artificial sequence
  Synthetic oligonucleotide
atctttaaggttctgc

SEQ ID NO: 68 - DNA, 16 bp, Artificial sequence
  Synthetic oligonucleotide
ctacttattgggatga

SEQ ID NO: 69 - DNA, 16 bp, Artificial sequence
  Synthetic oligonucleotide
cttattatacatacga

SEQ ID NO: 70 - DNA, 16 bp, Artificial sequence
  Synthetic oligonucleotide
gattctagagcctggc

SEQ ID NO: 71 - DNA, 16 bp, Artificial sequence
  Synthetic oligonucleotide
gcattacctgctgctc

SEQ ID NO: 72 - DNA, 16 bp, Artificial sequence
  Synthetic oligonucleotide
ctttataccagccctc

SEQ ID NO: 73 - DNA, 16 bp, Artificial sequence
  Synthetic oligonucleotide
cctgaatgtgaggtta

SEQ ID NO: 74 - DNA, 16 bp, Artificial sequence
  Synthetic oligonucleotide
tgctttaacaactcag

SEQ ID NO: 75 - DNA, 16 bp, Artificial sequence
  Synthetic oligonucleotide
tacattcgcatcatga

SEQ ID NO: 76 - DNA, 16 bp, Artificial sequence
  Synthetic oligonucleotide
gtatttattagagcac

SEQ ID NO: 77 - DNA, 16 bp, Artificial sequence
  Synthetic oligonucleotide
aggattaggagcttgg

SEQ ID NO: 78 - DNA, 16 bp, Artificial sequence
  Synthetic oligonucleotide
gaattacttagcaggg

SEQ ID NO: 79 - DNA, 16 bp, Artificial sequence
  Synthetic oligonucleotide
ccaaaatagttctccc

SEQ ID NO: 80 - DNA, 16 bp, Artificial sequence
  Synthetic oligonucleotide
aggtactgtttgctga

SEQ ID NO: 81 - DNA, 16 bp, Artificial sequence
  Synthetic oligonucleotide
cacatttgaggcacgg

SEQ ID NO: 82 - DNA, 16 bp, Artificial sequence
  Synthetic oligonucleotide
aggtttggatttgcgg

SEQ ID NO: 83 - DNA, 16 bp, Artificial sequence
  Synthetic oligonucleotide
ggctattttatgggtc

SEQ ID NO: 84 - DNA, 16 bp, Artificial sequence
  Synthetic oligonucleotide
gggaatatctggtatc

SEQ ID NO: 85 - DNA, 16 bp, Artificial sequence
  Synthetic oligonucleotide
gatcagtttggattca

SEQ ID NO: 86 - DNA, 16 bp, Artificial sequence
  Synthetic oligonucleotide
ggacatggttaggtgg

SEQ ID NO: 87 - DNA, 16 bp, Artificial sequence
  Synthetic oligonucleotide
ccaaatttttttcgat

SEQ ID NO: 88 - DNA, 16 bp, Artificial sequence
  Synthetic oligonucleotide
tgcttttataccgaga

SEQ ID NO: 89 - DNA, 16 bp, Artificial sequence
  Synthetic oligonucleotide
gtgcatgaaatgtggc

SEQ ID NO: 90 - DNA, 16 bp, Artificial sequence
  Synthetic oligonucleotide
ggatttgggaaggtgc

SEQ ID NO: 91 - DNA, 16 bp, Artificial sequence
  Synthetic oligonucleotide
ggagacattgtgccct

SEQ ID NO: 92 - DNA, 16 bp, Artificial sequence
  Synthetic oligonucleotide
tacgatgcagcaggag

SEQ ID NO: 93 - DNA, 16 bp, Artificial sequence
  Synthetic oligonucleotide
tggaacttgaagtagt

SEQ ID NO: 94 - DNA, 16 bp, Artificial sequence
  Synthetic oligonucleotide
gcctctggctccgttt

SEQ ID NO: 95 - DNA, 16 bp, Artificial sequence
  Synthetic oligonucleotide
caaaggatatgatggg

SEQ ID NO: 96 - DNA, 16 bp, Artificial sequence
  Synthetic oligonucleotide
gtgtactgaggcaggc

SEQ ID NO: 97 - DNA, 16 bp, Artificial sequence
  Synthetic oligonucleotide
gtgaattctaacaggc

SEQ ID NO: 98 - DNA, 16 bp, Artificial sequence
  Synthetic oligonucleotide
gggtatttttggcaag

SEQ ID NO: 99 - DNA, 16 bp, Artificial sequence
  Synthetic oligonucleotide
agctcggctgcagttt

SEQ ID NO: 100 - DNA, 16 bp, Artificial sequence
  Synthetic oligonucleotide
gcccagccgtgccccg

SEQ ID NO: 101 - DNA, 16 bp, Artificial sequence
  Synthetic oligonucleotide
cgagaagaaaaaccac

SEQ ID NO: 102 - DNA, 16 bp, Artificial sequence
  Synthetic oligonucleotide
ggccaggtgtagggtt

SEQ ID NO: 103 - DNA, 16 bp, Artificial sequence
  Synthetic oligonucleotide
ggcaggatggtttctg

SEQ ID NO: 104 - DNA, 16 bp, Artificial sequence
  Synthetic oligonucleotide
caccgttgagagctgg

SEQ ID NO: 105 - DNA, 16 bp, Artificial sequence
  Synthetic oligonucleotide
agacaccatttgccag

SEQ ID NO: 106 - DNA, 16 bp, Artificial sequence
  Synthetic oligonucleotide
ggtgaagtggactgac

SEQ ID NO: 107 - DNA, 16 bp, Artificial sequence
  Synthetic oligonucleotide
atccacggtccacaca

SEQ ID NO: 108 - DNA, 16 bp, Artificial sequence
  Synthetic oligonucleotide
gcccagcggatgagcg

SEQ ID NO: 109 - DNA, 16 bp, Artificial sequence
  Synthetic oligonucleotide
gcaaaggatatgatgg

SEQ ID NO: 110 - DNA, 16 bp, Artificial sequence
  Synthetic oligonucleotide
agctgaggcatggatc

SEQ ID NO: 111 - DNA, 16 bp, Artificial sequence
  Synthetic oligonucleotide
ctgcagggctcgactg

SEQ ID NO: 112 - DNA, 16 bp, Artificial sequence
  Synthetic oligonucleotide
ctccagagactgtacc

SEQ ID NO: 113 - DNA, 16 bp, Artificial sequence
  Synthetic oligonucleotide
agccgcagacctctct

SEQ ID NO: 114 - DNA, 16 bp, Artificial sequence
  Synthetic oligonucleotide
aagaaaaaccacgctg

SEQ ID NO: 115 - DNA, 16 bp, Artificial sequence
  Synthetic oligonucleotide
ttctaacaggccgtgt

SEQ ID NO: 116 - DNA, 16 bp, Artificial sequence
  Synthetic oligonucleotide
gaggaagtcctctggc

SEQ ID NO: 117 - DNA, 16 bp, Artificial sequence
  Synthetic oligonucleotide
gaggagacattgtgcc

SEQ ID NO: 118 - DNA, 16 bp, Artificial sequence
  Synthetic oligonucleotide
tctggaggagacattg

SEQ ID NO: 119 - DNA, 16 bp, Artificial sequence
  Synthetic oligonucleotide
ctcgaagatctcggcc

SEQ ID NO: 120 - DNA, 16 bp, Artificial sequence
  Synthetic oligonucleotide
agaaaaaccacgctgt

SEQ ID NO: 121 - DNA, 16 bp, Artificial sequence
  Synthetic oligonucleotide
ctaacaggccgtgtgt

SEQ ID NO: 122 - DNA, 16 bp, Artificial sequence
  Synthetic oligonucleotide
gggacaggattgtgac

SEQ ID NO: 123 - DNA, 16 bp, Artificial sequence
  Synthetic oligonucleotide
caagacagtggaaacc

SEQ ID NO: 124 - DNA, 16 bp, Artificial sequence
  Synthetic oligonucleotide
ggccatcccagtcacc

SEQ ID NO: 125 - DNA, 16 bp, Artificial sequence
  Synthetic oligonucleotide
accaacaacccacatc

SEQ ID NO: 126 - DNA, 16 bp, Artificial sequence
  Synthetic oligonucleotide
acccacatcccgttcc

SEQ ID NO: 127 - DNA, 16 bp, Artificial sequence
  Synthetic oligonucleotide
attaagtacttcacct

SEQ ID NO: 128 - DNA, 16 bp, Artificial sequence
  Synthetic oligonucleotide
atatggactctggtca

SEQ ID NO: 129 - DNA, 16 bp, Artificial sequence
  Synthetic oligonucleotide
aaaaatgcacgccccc

SEQ ID NO: 130 - DNA, 16 bp, Artificial sequence
  Synthetic oligonucleotide
gctatatatgtaatgg

SEQ ID NO: 131 - DNA, 16 bp, Artificial sequence
  Synthetic oligonucleotide
ataaccattgcagtac

SEQ ID NO: 132 - DNA, 16 bp, Artificial sequence
  Synthetic oligonucleotide
gtgaatagtcagtcca

SEQ ID NO: 133 - DNA, 16 bp, Artificial sequence
  Synthetic oligonucleotide
tcattaggtgtctgca

SEQ ID NO: 134 - DNA, 16 bp, Artificial sequence
  Synthetic oligonucleotide
caatcaaggttttcgg

SEQ ID NO: 135 - DNA, 16 bp, Artificial sequence
  Synthetic oligonucleotide
tagatttaaaggatcc

SEQ ID NO: 136 - DNA, 16 bp, Artificial sequence
  Synthetic oligonucleotide
ccagatttttccgcca

SEQ ID NO: 137 - DNA, 16 bp, Artificial sequence
  Synthetic oligonucleotide
agtatagaagggttct

SEQ ID NO: 138 - DNA, 16 bp, Artificial sequence
  Synthetic oligonucleotide
cagcatggcaagtgac

SEQ ID NO: 139 - DNA, 16 bp, Artificial sequence
  Synthetic oligonucleotide
agtgacatgggtttta

SEQ ID NO: 140 - DNA, 16 bp, Artificial sequence
  Synthetic oligonucleotide
gctattgtaacagtcc

SEQ ID NO: 141 - DNA, 16 bp, Artificial sequence
  Synthetic oligonucleotide
gtacatgtacataccc

SEQ ID NO: 142 - DNA, 16 bp, Artificial sequence
  Synthetic oligonucleotide
acagtaaaggtcggca

SEQ ID NO: 143 - DNA, 16 bp, Artificial sequence
  Synthetic oligonucleotide
ggccatcctgatcctc

SEQ ID NO: 144 - DNA, 16 bp, Artificial sequence
  Synthetic oligonucleotide
gcctacactgctcaca

SEQ ID NO: 145 - DNA, 16 bp, Artificial sequence
  Synthetic oligonucleotide
cacctatggaggctgt

SEQ ID NO: 146 - DNA, 16 bp, Artificial sequence
  Synthetic oligonucleotide
cttactacttattggg

SEQ ID NO: 147 - DNA, 16 bp, Artificial sequence
  Synthetic oligonucleotide
tcttattatacatacg

SEQ ID NO: 148 - DNA, 16 bp, Artificial sequence
  Synthetic oligonucleotide
tggcatgaggagtagc

SEQ ID NO: 149 - DNA, 16 bp, Artificial sequence
  Synthetic oligonucleotide
ggcattacctgctgct

SEQ ID NO: 150 - DNA, 16 bp, Artificial sequence
  Synthetic oligonucleotide
cctttataccagccct

SEQ ID NO: 151 - DNA, 16 bp, Artificial sequence
  Synthetic oligonucleotide
gggcatgtttggagct

SEQ ID NO: 152 - DNA, 16 bp, Artificial sequence
  Synthetic oligonucleotide
ggctatttgcatttgc

SEQ ID NO: 153 - DNA, 16 bp, Artificial sequence
  Synthetic oligonucleotide
atctgtacattcgcat

SEQ ID NO: 154 - DNA, 16 bp, Artificial sequence
  Synthetic oligonucleotide
cgtatttattagagca

SEQ ID NO: 155 - DNA, 16 bp, Artificial sequence
  Synthetic oligonucleotide
gcggatgcattttccc

SEQ ID NO: 156 - DNA, 16 bp, Artificial sequence
  Synthetic oligonucleotide
tggaattacttagcag

SEQ ID NO: 157 - DNA, 16 bp, Artificial sequence
  Synthetic oligonucleotide
gccaaaatagttctcc

SEQ ID NO: 158 - DNA, 16 bp, Artificial sequence
  Synthetic oligonucleotide
gtcaacacccgtgtcc

SEQ ID NO: 159 - DNA, 16 bp, Artificial sequence
  Synthetic oligonucleotide
tcacatttgaggcacg

SEQ ID NO: 160 - DNA, 16 bp, Artificial sequence
  Synthetic oligonucleotide
tggtttaggtttggat

SEQ ID NO: 161 - DNA, 16 bp, Artificial sequence
  Synthetic oligonucleotide
tagctttaggctattt

SEQ ID NO: 162 - DNA, 16 bp, Artificial sequence
  Synthetic oligonucleotide
gatgattgcagtgagg

SEQ ID NO: 163 - DNA, 16 bp, Artificial sequence
  Synthetic oligonucleotide
gggaatttgatcagtt

SEQ ID NO: 164 - DNA, 16 bp, Artificial sequence
  Synthetic oligonucleotide
gtttgaattatcgagt

SEQ ID NO: 165 - DNA, 16 bp, Artificial sequence
  Synthetic oligonucleotide
tccaaatttttttcga

SEQ ID NO: 166 - DNA, 16 bp, Artificial sequence
  Synthetic oligonucleotide
ggcatcgggtccttgt

SEQ ID NO: 167 - DNA, 16 bp, Artificial sequence
  Synthetic oligonucleotide
gggcatccaccgttga

SEQ ID NO: 168 - DNA, 16 bp, Artificial sequence
  Synthetic oligonucleotide
ttcctgggtgcactgg

SEQ ID NO: 169 - DNA, 16 bp, Artificial sequence
  Synthetic oligonucleotide
ctgcatggcactcagc

SEQ ID NO: 170 - DNA, 16 bp, Artificial sequence
  Synthetic oligonucleotide
gctacgatgcagcagg

SEQ ID NO: 171 - DNA, 16 bp, Artificial sequence
  Synthetic oligonucleotide
tctcattgagtgtccg

SEQ ID NO: 172 - DNA, 16 bp, Artificial sequence
  Synthetic oligonucleotide
ggcctatcatccctgc

SEQ ID NO: 173 - DNA, 16 bp, Artificial sequence
  Synthetic oligonucleotide
gtaatctgtgcgagca

SEQ ID NO: 174 - DNA, 16 bp, Artificial sequence
  Synthetic oligonucleotide
gatgatgcagctttga

SEQ ID NO: 175 - DNA, 16 bp, Artificial sequence
  Synthetic oligonucleotide
ggtgaattctaacagg

SEQ ID NO: 176 - DNA, 16 bp, Artificial sequence
  Synthetic oligonucleotide
taaatgagtagttcct

SEQ ID NO: 177 - DNA, 16 bp, Artificial sequence
  Synthetic oligonucleotide
tgccacagatgaagcc

SEQ ID NO: 178 - DNA, 16 bp, Artificial sequence
  Synthetic oligonucleotide
taccgagaagaaaaac

SEQ ID NO: 179 - DNA, 16 bp, Artificial sequence
  Synthetic oligonucleotide
agtgagggacaggatt

SEQ ID NO: 180 - DNA, 16 bp, Artificial sequence
  Synthetic oligonucleotide
cctcagatcctgaggg

SEQ ID NO: 181 - DNA, 16 bp, Artificial sequence
  Synthetic oligonucleotide
ccggagggtgccacca

SEQ ID NO: 182 - DNA, 16 bp, Artificial sequence
  Synthetic oligonucleotide
caaacaggctgtcagg

SEQ ID NO: 183 - DNA, 16 bp, Artificial sequence
  Synthetic oligonucleotide
cttttataccgagaag

SEQ ID NO: 184 - DNA, 16 bp, Artificial sequence
  Synthetic oligonucleotide
cgctctccacccgcac

SEQ ID NO: 185 - DNA, 16 bp, Artificial sequence
  Synthetic oligonucleotide
tggaagccgcagacct

SEQ ID NO: 186 - DNA, 16 bp, Artificial sequence
  Synthetic oligonucleotide
ctgcagtctaagctga

SEQ ID NO: 187 - DNA, 16 bp, Artificial sequence
  Synthetic oligonucleotide
ccccggagggtgccac

SEQ ID NO: 188 - DNA, 16 bp, Artificial sequence
  Synthetic oligonucleotide
actgaggcaggctctc

SEQ ID NO: 189 - DNA, 16 bp, Artificial sequence
  Synthetic oligonucleotide
gtgtagggttggaaca

SEQ ID NO: 190 - DNA, 16 bp, Artificial sequence
  Synthetic oligonucleotide
ggagaagaccccagtg

SEQ ID NO: 191 - DNA, 16 bp, Artificial sequence
  Synthetic oligonucleotide
gaagaaaaaccacgct

SEQ ID NO: 192 - DNA, 16 bp, Artificial sequence
  Synthetic oligonucleotide
ggctgcagtttattgg

SEQ ID NO: 193 - DNA, 16 bp, Artificial sequence
  Synthetic oligonucleotide
agaaaaggatcagcct

SEQ ID NO: 194 - DNA, 16 bp, Artificial sequence
  Synthetic oligonucleotide
ggtgtagggttggaac

SEQ ID NO: 195 - DNA, 16 bp, Artificial sequence
  Synthetic oligonucleotide
aaccacgctgtacggt

SEQ ID NO: 196 - DNA, 16 bp, Artificial sequence
  Synthetic oligonucleotide
gaaaaggatcagcctg

SEQ ID NO: 197 - DNA, 16 bp, Artificial sequence
  Synthetic oligonucleotide
tcgaagatctcggccc

SEQ ID NO: 198 - DNA, 16 bp, Artificial sequence
  Synthetic oligonucleotide
caccagtttggcccct

SEQ ID NO: 199 - DNA, 16 bp, Artificial sequence
  Synthetic oligonucleotide
ctgtacggtgtggaag

SEQ ID NO: 200 - DNA, 16 bp, Artificial sequence
  Synthetic oligonucleotide
tttataccgagaagaa

SEQ ID NO: 201 - DNA, 16 bp, Artificial sequence
  Synthetic oligonucleotide
ggcacttgaggccatc

SEQ ID NO: 202 - DNA, 16 bp, Artificial sequence
  Synthetic oligonucleotide
ccacatcccgttcctc

SEQ ID NO: 203 - DNA, 16 bp, Artificial sequence
  Synthetic oligonucleotide
cgccacctcagaggag

SEQ ID NO: 204 - DNA, 16 bp, Artificial sequence
  Synthetic oligonucleotide
aactgatgctcactct

SEQ ID NO: 205 - DNA, 16 bp, Artificial sequence
  Synthetic oligonucleotide
tgcagaatcgagctca

SEQ ID NO: 206 - DNA, 16 bp, Artificial sequence
  Synthetic oligonucleotide
cataataatactcacc

SEQ ID NO: 207 - DNA, 16 bp, Artificial sequence
  Synthetic oligonucleotide
caaatgatgaattggg

SEQ ID NO: 208 - DNA, 16 bp, Artificial sequence
  Synthetic oligonucleotide
gggtttattgtgtgtc

SEQ ID NO: 209 - DNA, 16 bp, Artificial sequence
  Synthetic oligonucleotide
tgagataattagggag

SEQ ID NO: 210 - DNA, 16 bp, Artificial sequence
  Synthetic oligonucleotide
cccttctacgctgtct

SEQ ID NO: 211 - DNA, 16 bp, Artificial sequence
  Synthetic oligonucleotide
gccaatacagagccca

SEQ ID NO: 212 - DNA, 16 bp, Artificial sequence
  Synthetic oligonucleotide
acagatactgggaccc

SEQ ID NO: 213 - DNA, 16 bp, Artificial sequence
  Synthetic oligonucleotide
gcatagatacattctc

SEQ ID NO: 214 - DNA, 16 bp, Artificial sequence
  Synthetic oligonucleotide
ggcttttcaggatcct

SEQ ID NO: 215 - DNA, 16 bp, Artificial sequence
  Synthetic oligonucleotide
tagacatgaagagtct

SEQ ID NO: 216 - DNA, 16 bp, Artificial sequence
  Synthetic oligonucleotide
ttaatctgaagctgga

SEQ ID NO: 217 - DNA, 16 bp, Artificial sequence
  Synthetic oligonucleotide
tcctattttgccccag

SEQ ID NO: 218 - DNA, 16 bp, Artificial sequence
  Synthetic oligonucleotide
ggtacatgtacatacc

SEQ ID NO: 219 - DNA, 16 bp, Artificial sequence
  Synthetic oligonucleotide
tgcataagtcacagac

SEQ ID NO: 220 - DNA, 16 bp, Artificial sequence
  Synthetic oligonucleotide
gtccatacctggtgca

SEQ ID NO: 221 - DNA, 16 bp, Artificial sequence
  Synthetic oligonucleotide
gagtactgcaattcag

SEQ ID NO: 222 - DNA, 16 bp, Artificial sequence
  Synthetic oligonucleotide
gtagactggcacaggc

SEQ ID NO: 223 - DNA, 16 bp, Artificial sequence
  Synthetic oligonucleotide
agtttagctcttgcat

SEQ ID NO: 224 - DNA, 16 bp, Artificial sequence
  Synthetic oligonucleotide
gggtaaataacagcac

SEQ ID NO: 225 - DNA, 16 bp, Artificial sequence
  Synthetic oligonucleotide
ggtgaccacgacaggc

SEQ ID NO: 226 - DNA, 16 bp, Artificial sequence
  Synthetic oligonucleotide
cactatccctatccct

SEQ ID NO: 227 - DNA, 16 bp, Artificial sequence
  Synthetic oligonucleotide
ccaggctacggtcttc

SEQ ID NO: 228 - DNA, 16 bp, Artificial sequence
  Synthetic oligonucleotide
aacaactcaggatcac

SEQ ID NO: 229 - DNA, 16 bp, Artificial sequence
  Synthetic oligonucleotide
ggttacatagctggtc

SEQ ID NO: 230 - DNA, 16 bp, Artificial sequence
  Synthetic oligonucleotide
ttgaatagggctcttt

SEQ ID NO: 231 - DNA, 16 bp, Artificial sequence
  Synthetic oligonucleotide
ccgtatttattagagc

SEQ ID NO: 232 - DNA, 16 bp, Artificial sequence
  Synthetic oligonucleotide
agcggatgcattttcc

SEQ ID NO: 233 - DNA, 16 bp, Artificial sequence
  Synthetic oligonucleotide
tggataggtgagctcg

SEQ ID NO: 234 - DNA, 16 bp, Artificial sequence
  Synthetic oligonucleotide
ttattctttgcaccac

SEQ ID NO: 235 - DNA, 16 bp, Artificial sequence
  Synthetic oligonucleotide
tgagatctcaccgtca

SEQ ID NO: 236 - DNA, 16 bp, Artificial sequence
  Synthetic oligonucleotide
ggtcacatttgaggca

SEQ ID NO: 237 - DNA, 16 bp, Artificial sequence
  Synthetic oligonucleotide
ctggatggtggtttag

SEQ ID NO: 238 - DNA, 16 bp, Artificial sequence
  Synthetic oligonucleotide
gtattgacatactggg

SEQ ID NO: 239 - DNA, 16 bp, Artificial sequence
  Synthetic oligonucleotide
agcgatgatgattgca

SEQ ID NO: 240 - DNA, 16 bp, Artificial sequence
  Synthetic oligonucleotide
agggaatttgatcagt

SEQ ID NO: 241 - DNA, 16 bp, Artificial sequence
  Synthetic oligonucleotide
ccaacttaagggtcag

SEQ ID NO: 242 - DNA, 16 bp, Artificial sequence
  Synthetic oligonucleotide
cgctgtacggtgtgga

SEQ ID NO: 243 - DNA, 16 bp, Artificial sequence
  Synthetic oligonucleotide
ggctttgggtgcagcc

SEQ ID NO: 244 - DNA, 16 bp, Artificial sequence
  Synthetic oligonucleotide
gatcatggctgggctc

SEQ ID NO: 245 - DNA, 16 bp, Artificial sequence
  Synthetic oligonucleotide
tgggtaggagctctgg

SEQ ID NO: 246 - DNA, 16 bp, Artificial sequence
  Synthetic oligonucleotide
gcctgcatggcactca

SEQ ID NO: 247 - DNA, 16 bp, Artificial sequence
  Synthetic oligonucleotide
agcagctacgatgcag

SEQ ID NO: 248 - DNA, 16 bp, Artificial sequence
  Synthetic oligonucleotide
gcaggatggtttctga

SEQ ID NO: 249 - DNA, 16 bp, Artificial sequence
  Synthetic oligonucleotide
gcacatccagggccta

SEQ ID NO: 250 - DNA, 16 bp, Artificial sequence
  Synthetic oligonucleotide
agtaatctgtgcgagc

SEQ ID NO: 251 - DNA, 16 bp, Artificial sequence
  Synthetic oligonucleotide
aattctaacaggccgt

SEQ ID NO: 252 - DNA, 16 bp, Artificial sequence
  Synthetic oligonucleotide
gtctgcacgggactca

SEQ ID NO: 253 - DNA, 16 bp, Artificial sequence
  Synthetic oligonucleotide
ataaatgagtagttcc

SEQ ID NO: 254 - DNA, 16 bp, Artificial sequence
  Synthetic oligonucleotide
gaagatctcggccctg

SEQ ID NO: 255 - DNA, 16 bp, Artificial sequence
  Synthetic oligonucleotide
aatgagtagttcctct

SEQ ID NO: 256 - DNA, 16 bp, Artificial sequence
  Synthetic oligonucleotide
accgagaagaaaaacc

SEQ ID NO: 257 - DNA, 16 bp, Artificial sequence
  Synthetic oligonucleotide
agctgcagctgcgatg

SEQ ID NO: 258 - DNA, 16 bp, Artificial sequence
  Synthetic oligonucleotide
ttataccgagaagaaa

SEQ ID NO: 259 - DNA, 16 bp, Artificial sequence
  Synthetic oligonucleotide
tactgaggcaggctct

SEQ ID NO: 260 - DNA, 16 bp, Artificial sequence
  Synthetic oligonucleotide
ccgcagacctctctct

SEQ ID NO: 261 - DNA, 16 bp, Artificial sequence
  Synthetic oligonucleotide
aaatgagtagttcctc

SEQ ID NO: 262 - DNA, 16 bp, Artificial sequence
  Synthetic oligonucleotide
tgccaccatgactagg

SEQ ID NO: 263 - DNA, 16 bp, Artificial sequence
  Synthetic oligonucleotide
gatgaagccttggtca

SEQ ID NO: 264 - DNA, 16 bp, Artificial sequence
  Synthetic oligonucleotide
tttgagtgtactgagg

SEQ ID NO: 265 - DNA, 16 bp, Artificial sequence
  Synthetic oligonucleotide
ggacaggattgtgaca

SEQ ID NO: 266 - DNA, 16 bp, Artificial sequence
  Synthetic oligonucleotide
gtgcgagcagctgagg

SEQ ID NO: 267 - DNA, 16 bp, Artificial sequence
  Synthetic oligonucleotide
gcttttataccgagaa

SEQ ID NO: 268 - DNA, 16 bp, Artificial sequence
  Synthetic oligonucleotide
cgaaagggtgctgtcc

SEQ ID NO: 269 - DNA, 16 bp, Artificial sequence
  Synthetic oligonucleotide
gccgaaagggtgctgt

SEQ ID NO: 270 - DNA, 16 bp, Artificial sequence
  Synthetic oligonucleotide
gtgaagtggactgaca

SEQ ID NO: 271 - DNA, 16 bp, Artificial sequence
  Synthetic oligonucleotide
aaaaaccacgctgtac

SEQ ID NO: 272 - DNA, 16 bp, Artificial sequence
  Synthetic oligonucleotide
ctaagctgaggcatgg

SEQ ID NO: 273 - DNA, 16 bp, Artificial sequence
  Synthetic oligonucleotide
ggacacccattccagg

SEQ ID NO: 274 - DNA, 16 bp, Artificial sequence
  Synthetic oligonucleotide
ggcttgtgggaaactg

SEQ ID NO: 275 - DNA, 16 bp, Artificial sequence
  Synthetic oligonucleotide
gggcaggcttggtgaa

SEQ ID NO: 276 - DNA, 16 bp, Artificial sequence
  Synthetic oligonucleotide
gtggaagccgcagacc

SEQ ID NO: 277 - DNA, 16 bp, Artificial sequence
  Synthetic oligonucleotide
cttgaagtagtccatg

SEQ ID NO: 278 - DNA, 16 bp, Artificial sequence
  Synthetic oligonucleotide
gtccactgacctgtcc

SEQ ID NO: 279 - DNA, 16 bp, Artificial sequence
  Synthetic oligonucleotide
tgcgatggcacttgag

SEQ ID NO: 280 - DNA, 16 bp, Artificial sequence
  Synthetic oligonucleotide
ctcagaggagctcacc

SEQ ID NO: 281 - DNA, 16 bp, Artificial sequence
  Synthetic oligonucleotide
tggcacttgaggccat

SEQ ID NO: 282 - DNA, 16 bp, Artificial sequence
  Synthetic oligonucleotide
gctactagggtgaaca

SEQ ID NO: 283 - DNA, 16 bp, Artificial sequence
  Synthetic oligonucleotide
aatagctaacacttcg

SEQ ID NO: 284 - DNA, 16 bp, Artificial sequence
  Synthetic oligonucleotide
ggagtaaggacatgac

SEQ ID NO: 285 - DNA, 16 bp, Artificial sequence
  Synthetic oligonucleotide
atcataagcatcacaa

SEQ ID NO: 286 - DNA, 16 bp, Artificial sequence
  Synthetic oligonucleotide
tataagttttaacacc

SEQ ID NO: 287 - DNA, 16 bp, Artificial sequence
  Synthetic oligonucleotide
tgtattgcaaagcaac

SEQ ID NO: 288 - DNA, 16 bp, Artificial sequence
  Synthetic oligonucleotide
gcatttcggtgaggcc

SEQ ID NO: 289 - DNA, 16 bp, Artificial sequence
  Synthetic oligonucleotide
tgcctttggtctgggc

SEQ ID NO: 290 - DNA, 16 bp, Artificial sequence
  Synthetic oligonucleotide
cactatgacaagcccc

SEQ ID NO: 291 - DNA, 16 bp, Artificial sequence
  Synthetic oligonucleotide
tcccttatggccccca

SEQ ID NO: 292 - DNA, 16 bp, Artificial sequence
  Synthetic oligonucleotide
ttctattgtcctcacc

SEQ ID NO: 293 - DNA, 16 bp, Artificial sequence
  Synthetic oligonucleotide
atagacatgaagagtc

SEQ ID NO: 294 - DNA, 16 bp, Artificial sequence
  Synthetic oligonucleotide
cttaatctgaagctgg

SEQ ID NO: 295 - DNA, 16 bp, Artificial sequence
  Synthetic oligonucleotide
catcttgccggagctg

SEQ ID NO: 296 - DNA, 16 bp, Artificial sequence
  Synthetic oligonucleotide
cccatagttgcacccc

SEQ ID NO: 297 - DNA, 16 bp, Artificial sequence
  Synthetic oligonucleotide
actacaatacggcctc

SEQ ID NO: 298 - DNA, 16 bp, Artificial sequence
  Synthetic oligonucleotide
gcccattcaccgtcca

SEQ ID NO: 299 - DNA, 16 bp, Artificial sequence
  Synthetic oligonucleotide
tctttaaggttctgca

SEQ ID NO: 300 - DNA, 16 bp, Artificial sequence
  Synthetic oligonucleotide
ggtagactggcacagg

SEQ ID NO: 301 - DNA, 16 bp, Artificial sequence
  Synthetic oligonucleotide
tattatacatacgaga

SEQ ID NO: 302 - DNA, 16 bp, Artificial sequence
  Synthetic oligonucleotide
agattttgatcaagac

SEQ ID NO: 303 - DNA, 16 bp, Artificial sequence
  Synthetic oligonucleotide
gaagattccatgcagg

SEQ ID NO: 304 - DNA, 16 bp, Artificial sequence
  Synthetic oligonucleotide
cgcactatccctatcc

SEQ ID NO: 305 - DNA, 16 bp, Artificial sequence
  Synthetic oligonucleotide
aggttaggttccctgc

SEQ ID NO: 306 - DNA, 16 bp, Artificial sequence
  Synthetic oligonucleotide
gctttaacaactcagg

SEQ ID NO: 307 - DNA, 16 bp, Artificial sequence
  Synthetic oligonucleotide
ggttatgtggcaccct

SEQ ID NO: 308 - DNA, 16 bp, Artificial sequence
  Synthetic oligonucleotide
ttattagagcacaggt

SEQ ID NO: 309 - DNA, 16 bp, Artificial sequence
  Synthetic oligonucleotide
tggaatcccacaaaac

SEQ ID NO: 310 - DNA, 16 bp, Artificial sequence
  Synthetic oligonucleotide
tacttagcagggtccc

SEQ ID NO: 311 - DNA, 16 bp, Artificial sequence
  Synthetic oligonucleotide
gtggataggtgagctc

SEQ ID NO: 312 - DNA, 16 bp, Artificial sequence
  Synthetic oligonucleotide
tgacataagttgtatc

SEQ ID NO: 313 - DNA, 16 bp, Artificial sequence
  Synthetic oligonucleotide
atgaatcaagccccat

SEQ ID NO: 314 - DNA, 16 bp, Artificial sequence
  Synthetic oligonucleotide
tggatttgcggacagg

SEQ ID NO: 315 - DNA, 16 bp, Artificial sequence
  Synthetic oligonucleotide
cagaatttggcatgct

SEQ ID NO: 316 - DNA, 16 bp, Artificial sequence
  Synthetic oligonucleotide
gtgtattgacatactg

SEQ ID NO: 317 - DNA, 16 bp, Artificial sequence
  Synthetic oligonucleotide
ggattacagagtcagc

SEQ ID NO: 318 - DNA, 16 bp, Artificial sequence
  Synthetic oligonucleotide
tggttaggtggttagg

SEQ ID NO: 319 - DNA, 16 bp, Artificial sequence
  Synthetic oligonucleotide
gggtatggttgttctg

SEQ ID NO: 320 - DNA, 16 bp, Artificial sequence
  Synthetic oligonucleotide
ttcgatgagtgtgtgc

SEQ ID NO: 321 - DNA, 16 bp, Artificial sequence
  Synthetic oligonucleotide
ctggcttgtgggaaac

SEQ ID NO: 322 - DNA, 16 bp, Artificial sequence
  Synthetic oligonucleotide
tggaaggttccccctg

SEQ ID NO: 323 - DNA, 16 bp, Artificial sequence
  Synthetic oligonucleotide
cccggagggtgccacc

SEQ ID NO: 324 - DNA, 16 bp, Artificial sequence
  Synthetic oligonucleotide
agaccccagtggcggt

SEQ ID NO: 325 - DNA, 16 bp, Artificial sequence
  Synthetic oligonucleotide
cagtgggtaggagctc

SEQ ID NO: 326 - DNA, 16 bp, Artificial sequence
  Synthetic oligonucleotide
acattgtgccctgccc

SEQ ID NO: 327 - DNA, 16 bp, Artificial sequence
  Synthetic oligonucleotide
gacgacagggccttgg

SEQ ID NO: 328 - DNA, 16 bp, Artificial sequence
  Synthetic oligonucleotide
catgttgtggaacttg

SEQ ID NO: 329 - DNA, 16 bp, Artificial sequence
  Synthetic oligonucleotide
cgtttcttgcggaact

SEQ ID NO: 330 - DNA, 16 bp, Artificial sequence
  Synthetic oligonucleotide
agtggaaacctcactt

SEQ ID NO: 331 - DNA, 16 bp, Artificial sequence
  Synthetic oligonucleotide
gacaggattgtgacat

SEQ ID NO: 332 - DNA, 16 bp, Artificial sequence
  Synthetic oligonucleotide
gcacacccctgtgttg

SEQ ID NO: 333 - DNA, 16 bp, Artificial sequence
  Synthetic oligonucleotide
tggcaaggcagtgtgt

SEQ ID NO: 334 - DNA, 16 bp, Artificial sequence
  Synthetic oligonucleotide
actgacctgtccttcc

SEQ ID NO: 335 - DNA, 16 bp, Artificial sequence
  Synthetic oligonucleotide
gcgatggcacttgagg

SEQ ID NO: 336 - DNA, 16 bp, Artificial sequence
  Synthetic oligonucleotide
tacctggctggaatca

SEQ ID NO: 337 - DNA, 16 bp, Artificial sequence
  Synthetic oligonucleotide
acagcatttcaagttg

SEQ ID NO: 338 - DNA, 16 bp, Artificial sequence
  Synthetic oligonucleotide
gatcgatggagtgtgg

SEQ ID NO: 339 - DNA, 16 bp, Artificial sequence
  Synthetic oligonucleotide
aatgtaaaggtcctcg

SEQ ID NO: 340 - DNA, 16 bp, Artificial sequence
  Synthetic oligonucleotide
aaagcgatacaagcaa

SEQ ID NO: 341 - DNA, 16 bp, Artificial sequence
  Synthetic oligonucleotide
agccctgaacaacctg

SEQ ID NO: 342 - DNA, 16 bp, Artificial sequence
  Synthetic oligonucleotide
cggcacttggtcaaat

SEQ ID NO: 343 - DNA, 16 bp, Artificial sequence
  Synthetic oligonucleotide
ataggacaaccttttg

SEQ ID NO: 344 - DNA, 16 bp, Artificial sequence
  Synthetic oligonucleotide
ctattaggagtaagga

SEQ ID NO: 345 - DNA, 16 bp, Artificial sequence
  Synthetic oligonucleotide
tatatgtaatggctga

SEQ ID NO: 346 - DNA, 16 bp, Artificial sequence
  Synthetic oligonucleotide
cctctatagtaaatgg

SEQ ID NO: 347 - DNA, 16 bp, Artificial sequence
  Synthetic oligonucleotide
gctaagtatttactgt

SEQ ID NO: 348 - DNA, 16 bp, Artificial sequence
  Synthetic oligonucleotide
aatagtcagtccatta

SEQ ID NO: 349 - DNA, 16 bp, Artificial sequence
  Synthetic oligonucleotide
gaaagcttggacatgg

SEQ ID NO: 350 - DNA, 16 bp, Artificial sequence
  Synthetic oligonucleotide
gcgagaggaggattgc

SEQ ID NO: 351 - DNA, 16 bp, Artificial sequence
  Synthetic oligonucleotide
attaggtgtctgcagg

SEQ ID NO: 352 - DNA, 16 bp, Artificial sequence
  Synthetic oligonucleotide
gagatctaggcttgga

SEQ ID NO: 353 - DNA, 16 bp, Artificial sequence
  Synthetic oligonucleotide
atcaccacgctctggc

SEQ ID NO: 354 - DNA, 16 bp, Artificial sequence
  Synthetic oligonucleotide
ccaaatacatggccac

SEQ ID NO: 355 - DNA, 16 bp, Artificial sequence
  Synthetic oligonucleotide
atcatagaacagcatt

SEQ ID NO: 356 - DNA, 16 bp, Artificial sequence
  Synthetic oligonucleotide
agacctggcccttctt

SEQ ID NO: 357 - DNA, 16 bp, Artificial sequence
  Synthetic oligonucleotide
ccgggcttcatcgaca

SEQ ID NO: 358 - DNA, 16 bp, Artificial sequence
  Synthetic oligonucleotide
tccctttctgactggg

SEQ ID NO: 359 - DNA, 16 bp, Artificial sequence
  Synthetic oligonucleotide
agagctaagaattctc

SEQ ID NO: 360 - DNA, 16 bp, Artificial sequence
  Synthetic oligonucleotide
ctgggagagcactggt

SEQ ID NO: 361 - DNA, 16 bp, Artificial sequence
  Synthetic oligonucleotide
gtatagaagggttctg

SEQ ID NO: 362 - DNA, 16 bp, Artificial sequence
  Synthetic oligonucleotide
cagccaaccccattat

SEQ ID NO: 363 - DNA, 16 bp, Artificial sequence
  Synthetic oligonucleotide
ctgtccaagccacgca

SEQ ID NO: 364 - DNA, 16 bp, Artificial sequence
  Synthetic oligonucleotide
aggaggcgagtccagg

SEQ ID NO: 365 - DNA, 16 bp, Artificial sequence
  Synthetic oligonucleotide
aaggaccgagctgaca

SEQ ID NO: 366 - DNA, 16 bp, Artificial sequence
  Synthetic oligonucleotide
gcgagaagtgggtaga

SEQ ID NO: 367 - DNA, 16 bp, Artificial sequence
  Synthetic oligonucleotide
tcctcggagtcctatt

SEQ ID NO: 368 - DNA, 16 bp, Artificial sequence
  Synthetic oligonucleotide
ggcttgcctgcccacg

SEQ ID NO: 369 - DNA, 16 bp, Artificial sequence
  Synthetic oligonucleotide
gtccaggtaccccacc

SEQ ID NO: 370 - DNA, 16 bp, Artificial sequence
  Synthetic oligonucleotide
acaatacggcctcctc

SEQ ID NO: 371 - DNA, 16 bp, Artificial sequence
  Synthetic oligonucleotide
actgcaagcccacatg

SEQ ID NO: 372 - DNA, 16 bp, Artificial sequence
  Synthetic oligonucleotide
ctgaggtgttaccagg

SEQ ID NO: 373 - DNA, 16 bp, Artificial sequence
  Synthetic oligonucleotide
ctgcatctttaaggtt

SEQ ID NO: 374 - DNA, 16 bp, Artificial sequence
  Synthetic oligonucleotide
gcttaaagacggccat

SEQ ID NO: 375 - DNA, 16 bp, Artificial sequence
  Synthetic oligonucleotide
acttattgggatgaag

SEQ ID NO: 376 - DNA, 16 bp, Artificial sequence
  Synthetic oligonucleotide
gtagcagggcaaagca

SEQ ID NO: 377 - DNA, 16 bp, Artificial sequence
  Synthetic oligonucleotide
taagggttgtgtgtag

SEQ ID NO: 378 - DNA, 16 bp, Artificial sequence
  Synthetic oligonucleotide
tgcctaagtagggaga

SEQ ID NO: 379 - DNA, 16 bp, Artificial sequence
  Synthetic oligonucleotide
aggctacggtcttccc

SEQ ID NO: 380 - DNA, 16 bp, Artificial sequence
  Synthetic oligonucleotide
agagggtttgtaagta

SEQ ID NO: 381 - DNA, 16 bp, Artificial sequence
  Synthetic oligonucleotide
ataaattaccaccagc

SEQ ID NO: 382 - DNA, 16 bp, Artificial sequence
  Synthetic oligonucleotide
tttcaaagcaaggacg

SEQ ID NO: 383 - DNA, 16 bp, Artificial sequence
  Synthetic oligonucleotide
atggagctcctttgca

SEQ ID NO: 384 - DNA, 16 bp, Artificial sequence
  Synthetic oligonucleotide
aggcatggccccaatc

SEQ ID NO: 385 - DNA, 16 bp, Artificial sequence
  Synthetic oligonucleotide
gctcctggaattactt

SEQ ID NO: 386 - DNA, 16 bp, Artificial sequence
  Synthetic oligonucleotide
gctaagcccacaggcc

SEQ ID NO: 387 - DNA, 16 bp, Artificial sequence
  Synthetic oligonucleotide
tgaaaagaagcggagt

SEQ ID NO: 388 - DNA, 16 bp, Artificial sequence
  Synthetic oligonucleotide
cgtcaacacccgtgtc

SEQ ID NO: 389 - DNA, 16 bp, Artificial sequence
  Synthetic oligonucleotide
gcaggacctcctagct

SEQ ID NO: 390 - DNA, 16 bp, Artificial sequence
  Synthetic oligonucleotide
ggaatggaggaaccca

SEQ ID NO: 391 - DNA, 16 bp, Artificial sequence
  Synthetic oligonucleotide
tccaggagagggttag

SEQ ID NO: 392 - DNA, 16 bp, Artificial sequence
  Synthetic oligonucleotide
atcaaatgggtgttac

SEQ ID NO: 393 - DNA, 16 bp, Artificial sequence
  Synthetic oligonucleotide
agtcagcgatgatgat

SEQ ID NO: 394 - DNA, 16 bp, Artificial sequence
  Synthetic oligonucleotide
gaattatcgagtatct

SEQ ID NO: 395 - DNA, 16 bp, Artificial sequence
  Synthetic oligonucleotide
aagggatcaggactga

SEQ ID NO: 396 - DNA, 16 bp, Artificial sequence
  Synthetic oligonucleotide
tttcgatgagtgtgtg

SEQ ID NO: 397 - DNA, 16 bp, Artificial sequence
  Synthetic oligonucleotide
cctggcttgtgggaaa

SEQ ID NO: 398 - DNA, 16 bp, Artificial sequence
  Synthetic oligonucleotide
ctggaaggttccccct

SEQ ID NO: 399 - DNA, 16 bp, Artificial sequence
  Synthetic oligonucleotide
gccccggagggtgcca

SEQ ID NO: 400 - DNA, 16 bp, Artificial sequence
  Synthetic oligonucleotide
aagaccccagtggcgg

SEQ ID NO: 401 - DNA, 16 bp, Artificial sequence
  Synthetic oligonucleotide
agcagtgggtaggagc

SEQ ID NO: 402 - DNA, 16 bp, Artificial sequence
  Synthetic oligonucleotide
ggaggagacattgtgc

SEQ ID NO: 403 - DNA, 16 bp, Artificial sequence
  Synthetic oligonucleotide
ggacgacagggccttg

SEQ ID NO: 404 - DNA, 16 bp, Artificial sequence
  Synthetic oligonucleotide
cgcatgttgtggaact

SEQ ID NO: 405 - DNA, 16 bp, Artificial sequence
  Synthetic oligonucleotide
ctccgtttcttgcgga

SEQ ID NO: 406 - DNA, 16 bp, Artificial sequence
  Synthetic oligonucleotide
cagtggaaacctcact

SEQ ID NO: 407 - DNA, 16 bp, Artificial sequence
  Synthetic oligonucleotide
gagggacaggattgtg

SEQ ID NO: 408 - DNA, 16 bp, Artificial sequence
  Synthetic oligonucleotide
gggcacacccctgtgt

SEQ ID NO: 409 - DNA, 16 bp, Artificial sequence
  Synthetic oligonucleotide
ttggcaaggcagtgtg

SEQ ID NO: 410 - DNA, 16 bp, Artificial sequence
  Synthetic oligonucleotide
cactgacctgtccttc

SEQ ID NO: 411 - DNA, 16 bp, Artificial sequence
  Synthetic oligonucleotide
ctgcgatggcacttga

SEQ ID NO: 412 - DNA, 16 bp, Artificial sequence
  Synthetic oligonucleotide
ttacctggctggaatc

SEQ ID NO: 413 - DNA, 16 bp, Artificial sequence
  Synthetic oligonucleotide
gacagcatttcaagtt

SEQ ID NO: 414 - DNA, 16 bp, Artificial sequence
  Synthetic oligonucleotide
agatcgatggagtgtg

SEQ ID NO: 415 - DNA, 16 bp, Artificial sequence
  Synthetic oligonucleotide
aaatgtaaaggtcctc

SEQ ID NO: 416 - DNA, 16 bp, Artificial sequence
  Synthetic oligonucleotide
taaagcgatacaagca

SEQ ID NO: 417 - DNA, 16 bp, Artificial sequence
  Synthetic oligonucleotide
cagccctgaacaacct

SEQ ID NO: 418 - DNA, 16 bp, Artificial sequence
  Synthetic oligonucleotide
atcggcacttggtcaa

SEQ ID NO: 419 - DNA, 16 bp, Artificial sequence
  Synthetic oligonucleotide
aataggacaacctttt

SEQ ID NO: 420 - DNA, 16 bp, Artificial sequence
  Synthetic oligonucleotide
cctattaggagtaagg

SEQ ID NO: 421 - DNA, 16 bp, Artificial sequence
  Synthetic oligonucleotide
atatatgtaatggctg

SEQ ID NO: 422 - DNA, 16 bp, Artificial sequence
  Synthetic oligonucleotide
acctctatagtaaatg

SEQ ID NO: 423 - DNA, 16 bp, Artificial sequence
  Synthetic oligonucleotide
ggtttattgtgtgtca

SEQ ID NO: 424 - DNA, 16 bp, Artificial sequence
  Synthetic oligonucleotide
gaatagtcagtccatt

SEQ ID NO: 425 - DNA, 16 bp, Artificial sequence
  Synthetic oligonucleotide
tagaaagcttggacat

SEQ ID NO: 426 - DNA, 16 bp, Artificial sequence
  Synthetic oligonucleotide
gtgcgagaggaggatt

SEQ ID NO: 427 - DNA, 16 bp, Artificial sequence
  Synthetic oligonucleotide
cattaggtgtctgcag

SEQ ID NO: 428 - DNA, 16 bp, Artificial sequence
  Synthetic oligonucleotide
tgagatctaggcttgg

SEQ ID NO: 429 - DNA, 16 bp, Artificial sequence
  Synthetic oligonucleotide
catcaccacgctctgg

SEQ ID NO: 430 - DNA, 16 bp, Artificial sequence
  Synthetic oligonucleotide
cccaaatacatggcca

SEQ ID NO: 431 - DNA, 16 bp, Artificial sequence
  Synthetic oligonucleotide
gaatcatagaacagca

SEQ ID NO: 432 - DNA, 16 bp, Artificial sequence
  Synthetic oligonucleotide
tctgaagacctggccc

SEQ ID NO: 433 - DNA, 16 bp, Artificial sequence
  Synthetic oligonucleotide
tgcgccgggcttcatc

SEQ ID NO: 434 - DNA, 16 bp, Artificial sequence
  Synthetic oligonucleotide
ctgcactgtctgttgg

SEQ ID NO: 435 - DNA, 16 bp, Artificial sequence
  Synthetic oligonucleotide
ccagagctaagaattc

SEQ ID NO: 436 - DNA, 16 bp, Artificial sequence
  Synthetic oligonucleotide
ggcctgggagagcact

SEQ ID NO: 437 - DNA, 16 bp, Artificial sequence
  Synthetic oligonucleotide
gagtatagaagggttc

SEQ ID NO: 438 - DNA, 16 bp, Artificial sequence
  Synthetic oligonucleotide
tggaagggactgccca

SEQ ID NO: 439 - DNA, 16 bp, Artificial sequence
  Synthetic oligonucleotide
cctgtccaagccacgc

SEQ ID NO: 440 - DNA, 16 bp, Artificial sequence
  Synthetic oligonucleotide
aaggaggcgagtccag

SEQ ID NO: 441 - DNA, 16 bp, Artificial sequence
  Synthetic oligonucleotide
gaaggaccgagctgac

SEQ ID NO: 442 - DNA, 16 bp, Artificial sequence
  Synthetic oligonucleotide
aggcgagaagtgggta

SEQ ID NO: 443 - DNA, 16 bp, Artificial sequence
  Synthetic oligonucleotide
ctcctcggagtcctat

SEQ ID NO: 444 - DNA, 16 bp, Artificial sequence
  Synthetic oligonucleotide
gcacctggcttgcctg

SEQ ID NO: 445 - DNA, 16 bp, Artificial sequence
  Synthetic oligonucleotide
cggcacctgtaggtcc

SEQ ID NO: 446 - DNA, 16 bp, Artificial sequence
  Synthetic oligonucleotide
tacaatacggcctcct

SEQ ID NO: 447 - DNA, 16 bp, Artificial sequence
  Synthetic oligonucleotide
cactgcaagcccacat

SEQ ID NO: 448 - DNA, 16 bp, Artificial sequence
  Synthetic oligonucleotide
gctgaggtgttaccag

SEQ ID NO: 449 - DNA, 16 bp, Artificial sequence
  Synthetic oligonucleotide
gattttgacattctgc

SEQ ID NO: 450 - DNA, 16 bp, Artificial sequence
  Synthetic oligonucleotide
agcttaaagacggcca

SEQ ID NO: 451 - DNA, 16 bp, Artificial sequence
  Synthetic oligonucleotide
tacttattgggatgaa

SEQ ID NO: 452 - DNA, 16 bp, Artificial sequence
  Synthetic oligonucleotide
gagtagcagggcaaag

SEQ ID NO: 453 - DNA, 16 bp, Artificial sequence
  Synthetic oligonucleotide
ctaagggttgtgtgta

SEQ ID NO: 454 - DNA, 16 bp, Artificial sequence
  Synthetic oligonucleotide
gtgcctaagtagggag

SEQ ID NO: 455 - DNA, 16 bp, Artificial sequence
  Synthetic oligonucleotide
caggctacggtcttcc

SEQ ID NO: 456 - DNA, 16 bp, Artificial sequence
  Synthetic oligonucleotide
cagagggtttgtaagt

SEQ ID NO: 457 - DNA, 16 bp, Artificial sequence
  Synthetic oligonucleotide
tcgcatcatgagaaat

SEQ ID NO: 458 - DNA, 16 bp, Artificial sequence
  Synthetic oligonucleotide
gcttaaacttcccact

SEQ ID NO: 459 - DNA, 16 bp, Artificial sequence
  Synthetic oligonucleotide
catggagctcctttgc

SEQ ID NO: 460 - DNA, 16 bp, Artificial sequence
  Synthetic oligonucleotide
gaggcatggccccaat

SEQ ID NO: 461 - DNA, 16 bp, Artificial sequence
  Synthetic oligonucleotide
ggaaaggaggtgctcc

SEQ ID NO: 462 - DNA, 16 bp, Artificial sequence
  Synthetic oligonucleotide
ctgctaagcccacagg

SEQ ID NO: 463 - DNA, 16 bp, Artificial sequence
  Synthetic oligonucleotide
ttgaaaagaagcggag

SEQ ID NO: 464 - DNA, 16 bp, Artificial sequence
  Synthetic oligonucleotide
caccgtcaacacccgt

SEQ ID NO: 465 - DNA, 16 bp, Artificial sequence
  Synthetic oligonucleotide
atgcaggacctcctag

SEQ ID NO: 466 - DNA, 16 bp, Artificial sequence
  Synthetic oligonucleotide
gggaatggaggaaccc

SEQ ID NO: 467 - DNA, 16 bp, Artificial sequence
  Synthetic oligonucleotide
gtccaggagagggtta

SEQ ID NO: 468 - DNA, 16 bp, Artificial sequence
  Synthetic oligonucleotide
gatcaaatgggtgtta

SEQ ID NO: 469 - DNA, 16 bp, Artificial sequence
  Synthetic oligonucleotide
cagagtcagcgatgat

SEQ ID NO: 470 - DNA, 16 bp, Artificial sequence
  Synthetic oligonucleotide
tgaattatcgagtatc

SEQ ID NO: 471 - DNA, 16 bp, Artificial sequence
  Synthetic oligonucleotide
gtaagggatcaggact

SEQ ID NO: 472 - DNA, 16 bp, Artificial sequence
  Synthetic oligonucleotide
tttttcgatgagtgtg

SEQ ID NO: 473 - DNA, 16 bp, Artificial sequence
  Synthetic oligonucleotide
aaggatcagcctggct

SEQ ID NO: 474 - DNA, 16 bp, Artificial sequence
  Synthetic oligonucleotide
ccctggaaggttcccc

SEQ ID NO: 475 - DNA, 16 bp, Artificial sequence
  Synthetic oligonucleotide
ggagtgcctgtaagtg

SEQ ID NO: 476 - DNA, 16 bp, Artificial sequence
  Synthetic oligonucleotide
agaagaccccagtggc

SEQ ID NO: 477 - DNA, 16 bp, Artificial sequence
  Synthetic oligonucleotide
acaccatttgccagca

SEQ ID NO: 478 - DNA, 16 bp, Artificial sequence
  Synthetic oligonucleotide
ctggaggagacattgt

SEQ ID NO: 479 - DNA, 16 bp, Artificial sequence
  Synthetic oligonucleotide
aaacaggctgtcaggg

SEQ ID NO: 480 - DNA, 16 bp, Artificial sequence
  Synthetic oligonucleotide
gtcgcatgttgtggaa

SEQ ID NO: 481 - DNA, 16 bp, Artificial sequence
  Synthetic oligonucleotide
ctggctccgtttcttg

SEQ ID NO: 482 - DNA, 16 bp, Artificial sequence
  Synthetic oligonucleotide
gacagtggaaacctca

SEQ ID NO: 483 - DNA, 16 bp, Artificial sequence
  Synthetic oligonucleotide
gtgagggacaggattg

SEQ ID NO: 484 - DNA, 16 bp, Artificial sequence
  Synthetic oligonucleotide
gtgtaggcctctgggc

SEQ ID NO: 485 - DNA, 16 bp, Artificial sequence
  Synthetic oligonucleotide
tttttggcaaggcagt

SEQ ID NO: 486 - DNA, 16 bp, Artificial sequence
  Synthetic oligonucleotide
tccactgacctgtcct

SEQ ID NO: 487 - DNA, 16 bp, Artificial sequence
  Synthetic oligonucleotide
agctgcgatggcactt

SEQ ID NO: 488 - DNA, 16 bp, Artificial sequence
  Synthetic oligonucleotide
accttggtgaagtgga

SEQ ID NO: 489 - DNA, 16 bp, Artificial sequence
  Synthetic oligonucleotide
ccttacctggctggaa

SEQ ID NO: 490 - DNA, 16 bp, Artificial sequence
  Synthetic oligonucleotide
cagttgcacctggaca

SEQ ID NO: 491 - DNA, 16 bp, Artificial sequence
  Synthetic oligonucleotide
ggagatcgatggagtg

SEQ ID NO: 492 - DNA, 16 bp, Artificial sequence
  Synthetic oligonucleotide
gaactgatgctcactc

SEQ ID NO: 493 - DNA, 16 bp, Artificial sequence
  Synthetic oligonucleotide
tctaaagcgatacaag

SEQ ID NO: 494 - DNA, 16 bp, Artificial sequence
  Synthetic oligonucleotide
aatcgagctcacccca

SEQ ID NO: 495 - DNA, 16 bp, Artificial sequence
  Synthetic oligonucleotide
acaatcggcacttggt

SEQ ID NO: 496 - DNA, 16 bp, Artificial sequence
  Synthetic oligonucleotide
gagcataaaataggac

SEQ ID NO: 497 - DNA, 16 bp, Artificial sequence
  Synthetic oligonucleotide
accctattaggagtaa

SEQ ID NO: 498 - DNA, 16 bp, Artificial sequence
  Synthetic oligonucleotide
catcataagcatcaca

SEQ ID NO: 499 - DNA, 16 bp, Artificial sequence
  Synthetic oligonucleotide
cttaacctctatagta

SEQ ID NO: 500 - DNA, 16 bp, Artificial sequence
  Synthetic oligonucleotide
gatcttgggtttattg

SEQ ID NO: 501 - DNA, 16 bp, Artificial sequence
  Synthetic oligonucleotide
agtgaatagtcagtcc

SEQ ID NO: 502 - DNA, 16 bp, Artificial sequence
  Synthetic oligonucleotide
cctggtataagaacag

SEQ ID NO: 503 - DNA, 16 bp, Artificial sequence
  Synthetic oligonucleotide
ggacacatgcatggag

SEQ ID NO: 504 - DNA, 16 bp, Artificial sequence
  Synthetic oligonucleotide
agtcattaggtgtctg

SEQ ID NO: 505 - DNA, 16 bp, Artificial sequence
  Synthetic oligonucleotide
cctgagatctaggctt

SEQ ID NO: 506 - DNA, 16 bp, Artificial sequence
  Synthetic oligonucleotide
actgacatgcctccat

SEQ ID NO: 507 - DNA, 16 bp, Artificial sequence
  Synthetic oligonucleotide
gtccactctggaacaa

SEQ ID NO: 508 - DNA, 16 bp, Artificial sequence
  Synthetic oligonucleotide
gtataacaccaggacc

SEQ ID NO: 509 - DNA, 16 bp, Artificial sequence
  Synthetic oligonucleotide
cccctagctctgaaga

SEQ ID NO: 510 - DNA, 16 bp, Artificial sequence
  Synthetic oligonucleotide
cggccggatgcgccgg

SEQ ID NO: 511 - DNA, 16 bp, Artificial sequence
  Synthetic oligonucleotide
gccggcttcctgcact

SEQ ID NO: 512 - DNA, 16 bp, Artificial sequence
  Synthetic oligonucleotide
ggccagagctaagaat

SEQ ID NO: 513 - DNA, 16 bp, Artificial sequence
  Synthetic oligonucleotide
ctccgaacaagggcct

SEQ ID NO: 514 - DNA, 16 bp, Artificial sequence
  Synthetic oligonucleotide
ctgagttgggcacaca

SEQ ID NO: 515 - DNA, 16 bp, Artificial sequence
  Synthetic oligonucleotide
tcctggtctgagagga

SEQ ID NO: 516 - DNA, 16 bp, Artificial sequence
  Synthetic oligonucleotide
gcctcaaatgcccact

SEQ ID NO: 517 - DNA, 16 bp, Artificial sequence
  Synthetic oligonucleotide
gcaaggaggcgagtcc

SEQ ID NO: 518 - DNA, 16 bp, Artificial sequence
  Synthetic oligonucleotide
tggaaggaccgagctg

SEQ ID NO: 519 - DNA, 16 bp, Artificial sequence
  Synthetic oligonucleotide
gagaaggcgagaagtg

SEQ ID NO: 520 - DNA, 16 bp, Artificial sequence
  Synthetic oligonucleotide
gtctcggactttctcc

SEQ ID NO: 521 - DNA, 16 bp, Artificial sequence
  Synthetic oligonucleotide
ccacacatgccccacg

SEQ ID NO: 522 - DNA, 16 bp, Artificial sequence
  Synthetic oligonucleotide
gtcggcacctgtaggt

SEQ ID NO: 523 - DNA, 16 bp, Artificial sequence
  Synthetic oligonucleotide
gactacaatacggcct

SEQ ID NO: 524 - DNA, 16 bp, Artificial sequence
  Synthetic oligonucleotide
ctctgcactgcaagcc

SEQ ID NO: 525 - DNA, 16 bp, Artificial sequence
  Synthetic oligonucleotide
agcctacactgctcac

SEQ ID NO: 526 - DNA, 16 bp, Artificial sequence
  Synthetic oligonucleotide
tgtaaagctctgtggt

SEQ ID NO: 527 - DNA, 16 bp, Artificial sequence
  Synthetic oligonucleotide
gaagcttaaagacggc

SEQ ID NO: 528 - DNA, 16 bp, Artificial sequence
  Synthetic oligonucleotide
tactacttattgggat

SEQ ID NO: 529 - DNA, 16 bp, Artificial sequence
  Synthetic oligonucleotide
aggagtagcagggcaa

SEQ ID NO: 530 - DNA, 16 bp, Artificial sequence
  Synthetic oligonucleotide
tgctaagggttgtgtg

SEQ ID NO: 531 - DNA, 16 bp, Artificial sequence
  Synthetic oligonucleotide
tccgcctggcagtgcc

SEQ ID NO: 532 - DNA, 16 bp, Artificial sequence
  Synthetic oligonucleotide
acatgaggcctcagcc

SEQ ID NO: 533 - DNA, 16 bp, Artificial sequence
  Synthetic oligonucleotide
gtcagagggtttgtaa

SEQ ID NO: 534 - DNA, 16 bp, Artificial sequence
  Synthetic oligonucleotide
attcgcatcatgagaa

SEQ ID NO: 535 - DNA, 16 bp, Artificial sequence
  Synthetic oligonucleotide
aggcttaaacttccca

SEQ ID NO: 536 - DNA, 16 bp, Artificial sequence
  Synthetic oligonucleotide
cagcatggagctcctt

SEQ ID NO: 537 - DNA, 16 bp, Artificial sequence
  Synthetic oligonucleotide
ggtgaggcatggcccc

SEQ ID NO: 538 - DNA, 16 bp, Artificial sequence
  Synthetic oligonucleotide
gattttccttggtcag

SEQ ID NO: 539 - DNA, 16 bp, Artificial sequence
  Synthetic oligonucleotide
ctctgatccctgctaa

SEQ ID NO: 540 - DNA, 16 bp, Artificial sequence
  Synthetic oligonucleotide
ccgaggttgaaaagaa

SEQ ID NO: 541 - DNA, 16 bp, Artificial sequence
  Synthetic oligonucleotide
agatctcaccgtcaac

SEQ ID NO: 542 - DNA, 16 bp, Artificial sequence
  Synthetic oligonucleotide
ccccatgcaggacctc

SEQ ID NO: 543 - DNA, 16 bp, Artificial sequence
  Synthetic oligonucleotide
ttgggaatggaggaac

SEQ ID NO: 544 - DNA, 16 bp, Artificial sequence
  Synthetic oligonucleotide
ctattttatgggtcca

SEQ ID NO: 545 - DNA, 16 bp, Artificial sequence
  Synthetic oligonucleotide
ttaaggatcaaatggg

SEQ ID NO: 546 - DNA, 16 bp, Artificial sequence
  Synthetic oligonucleotide
tacagagtcagcgatg

SEQ ID NO: 547 - DNA, 16 bp, Artificial sequence
  Synthetic oligonucleotide
tttgaattatcgagta

SEQ ID NO: 548 - DNA, 16 bp, Artificial sequence
  Synthetic oligonucleotide
aggtaagggatcagga

SEQ ID NO: 549 - DNA, 16 bp, Artificial sequence
  Synthetic oligonucleotide
ttttttcgatgagtgt

SEQ ID NO: 550 - DNA, 16 bp, Artificial sequence
  Synthetic oligonucleotide
agtggactgacagaaa

SEQ ID NO: 551 - DNA, 16 bp, Artificial sequence
  Synthetic oligonucleotide
gccctggaaggttccc

SEQ ID NO: 552 - DNA, 16 bp, Artificial sequence
  Synthetic oligonucleotide
gaggagtgcctgtaag

SEQ ID NO: 553 - DNA, 16 bp, Artificial sequence
  Synthetic oligonucleotide
gggagaagaccccagt

SEQ ID NO: 554 - DNA, 16 bp, Artificial sequence
  Synthetic oligonucleotide
tgcagacaccatttgc

SEQ ID NO: 555 - DNA, 16 bp, Artificial sequence
  Synthetic oligonucleotide
gactgtaccatctctc

SEQ ID NO: 556 - DNA, 16 bp, Artificial sequence
  Synthetic oligonucleotide
ggacagcaaacaggct

SEQ ID NO: 557 - DNA, 16 bp, Artificial sequence
  Synthetic oligonucleotide
ggtcgcatgttgtgga

SEQ ID NO: 558 - DNA, 16 bp, Artificial sequence
  Synthetic oligonucleotide
cctctggctccgtttc

SEQ ID NO: 559 - DNA, 16 bp, Artificial sequence
  Synthetic oligonucleotide
agacagtggaaacctc

SEQ ID NO: 560 - DNA, 16 bp, Artificial sequence
  Synthetic oligonucleotide
gagtgagggacaggat

SEQ ID NO: 561 - DNA, 16 bp, Artificial sequence
  Synthetic oligonucleotide
tgtgtaggcctctggg

SEQ ID NO: 562 - DNA, 16 bp, Artificial sequence
  Synthetic oligonucleotide
gtatttttggcaaggc

SEQ ID NO: 563 - DNA, 16 bp, Artificial sequence
  Synthetic oligonucleotide
ctgtccactgacctgt

SEQ ID NO: 564 - DNA, 16 bp, Artificial sequence
  Synthetic oligonucleotide
actttgagctgcgatg

SEQ ID NO: 565 - DNA, 16 bp, Artificial sequence
  Synthetic oligonucleotide
caccttggtgaagtgg

SEQ ID NO: 566 - DNA, 16 bp, Artificial sequence
  Synthetic oligonucleotide
accttacctggctgga

SEQ ID NO: 567 - DNA, 16 bp, Artificial sequence
  Synthetic oligonucleotide
tcagttgcacctggac

SEQ ID NO: 568 - DNA, 16 bp, Artificial sequence
  Synthetic oligonucleotide
aggagatcgatggagt

SEQ ID NO: 569 - DNA, 16 bp, Artificial sequence
  Synthetic oligonucleotide
agaactgatgctcact

SEQ ID NO: 570 - DNA, 16 bp, Artificial sequence
  Synthetic oligonucleotide
ctctaaagcgatacaa

SEQ ID NO: 571 - DNA, 16 bp, Artificial sequence
  Synthetic oligonucleotide
gaatcgagctcacccc

SEQ ID NO: 572 - DNA, 16 bp, Artificial sequence
  Synthetic oligonucleotide
aacaatcggcacttgg

SEQ ID NO: 573 - DNA, 16 bp, Artificial sequence
  Synthetic oligonucleotide
ggagcataaaatagga

SEQ ID NO: 574 - DNA, 16 bp, Artificial sequence
  Synthetic oligonucleotide
caccctattaggagta

SEQ ID NO: 575 - DNA, 16 bp, Artificial sequence
  Synthetic oligonucleotide
ccatcataagcatcac

SEQ ID NO: 576 - DNA, 16 bp, Artificial sequence
  Synthetic oligonucleotide
tcttaacctctatagt

SEQ ID NO: 577 - DNA, 16 bp, Artificial sequence
  Synthetic oligonucleotide
ctgatcttgggtttat

SEQ ID NO: 578 - DNA, 16 bp, Artificial sequence
  Synthetic oligonucleotide
gagtgaatagtcagtc

SEQ ID NO: 579 - DNA, 16 bp, Artificial sequence
  Synthetic oligonucleotide
gcaaaacagtgtggcc

SEQ ID NO: 580 - DNA, 16 bp, Artificial sequence
  Synthetic oligonucleotide
gatagtgagagacatt

SEQ ID NO: 581 - DNA, 16 bp, Artificial sequence
  Synthetic oligonucleotide
aagtcattaggtgtct

SEQ ID NO: 582 - DNA, 16 bp, Artificial sequence
  Synthetic oligonucleotide
tcctgagatctaggct

SEQ ID NO: 583 - DNA, 16 bp, Artificial sequence
  Synthetic oligonucleotide
cctgactgactgacat

SEQ ID NO: 584 - DNA, 16 bp, Artificial sequence
  Synthetic oligonucleotide
ctgtccactctggaac

SEQ ID NO: 585 - DNA, 16 bp, Artificial sequence
  Synthetic oligonucleotide
agtataacaccaggac

SEQ ID NO: 586 - DNA, 16 bp, Artificial sequence
  Synthetic oligonucleotide
tgacaagcccctagct

SEQ ID NO: 587 - DNA, 16 bp, Artificial sequence
  Synthetic oligonucleotide
atggcggccggatgcg

SEQ ID NO: 588 - DNA, 16 bp, Artificial sequence
  Synthetic oligonucleotide
cagccggcttcctgca

SEQ ID NO: 589 - DNA, 16 bp, Artificial sequence
  Synthetic oligonucleotide
cacttggccagagcta

SEQ ID NO: 590 - DNA, 16 bp, Artificial sequence
  Synthetic oligonucleotide
gctccgaacaagggcc

SEQ ID NO: 591 - DNA, 16 bp, Artificial sequence
  Synthetic oligonucleotide
actgagttgggcacac

SEQ ID NO: 592 - DNA, 16 bp, Artificial sequence
  Synthetic oligonucleotide
atcctggtctgagagg

SEQ ID NO: 593 - DNA, 16 bp, Artificial sequence
  Synthetic oligonucleotide
ccaatttctggccctc

SEQ ID NO: 594 - DNA, 16 bp, Artificial sequence
  Synthetic oligonucleotide
ggcaaggaggcgagtc

SEQ ID NO: 595 - DNA, 16 bp, Artificial sequence
  Synthetic oligonucleotide
ctggaaggaccgagct

SEQ ID NO: 596 - DNA, 16 bp, Artificial sequence
  Synthetic oligonucleotide
ggagaaggcgagaagt

SEQ ID NO: 597 - DNA, 16 bp, Artificial sequence
  Synthetic oligonucleotide
gccggagctggtctcg

SEQ ID NO: 598 - DNA, 16 bp, Artificial sequence
  Synthetic oligonucleotide
ccatagttgcacccca

SEQ ID NO: 599 - DNA, 16 bp, Artificial sequence
  Synthetic oligonucleotide
aggtcggcacctgtag

SEQ ID NO: 600 - DNA, 16 bp, Artificial sequence
  Synthetic oligonucleotide
ggactacaatacggcc

SEQ ID NO: 601 - DNA, 16 bp, Artificial sequence
  Synthetic oligonucleotide
aaatactctgcactgc

SEQ ID NO: 602 - DNA, 16 bp, Artificial sequence
  Synthetic oligonucleotide
tagcctacactgctca

SEQ ID NO: 603 - DNA, 16 bp, Artificial sequence
  Synthetic oligonucleotide
agctttgtaaagctct

SEQ ID NO: 604 - DNA, 16 bp, Artificial sequence
  Synthetic oligonucleotide
agaagcttaaagacgg

SEQ ID NO: 605 - DNA, 16 bp, Artificial sequence
  Synthetic oligonucleotide
ttactacttattggga

SEQ ID NO: 606 - DNA, 16 bp, Artificial sequence
  Synthetic oligonucleotide
tgaggagtagcagggc

SEQ ID NO: 607 - DNA, 16 bp, Artificial sequence
  Synthetic oligonucleotide
ctgctaagggttgtgt

SEQ ID NO: 608 - DNA, 16 bp, Artificial sequence
  Synthetic oligonucleotide
attacctgctgctcca

SEQ ID NO: 609 - DNA, 16 bp, Artificial sequence
  Synthetic oligonucleotide
aacatgaggcctcagc

SEQ ID NO: 610 - DNA, 16 bp, Artificial sequence
  Synthetic oligonucleotide
tcttagagtcagaggg

SEQ ID NO: 611 - DNA, 16 bp, Artificial sequence
  Synthetic oligonucleotide
acattcgcatcatgag

SEQ ID NO: 612 - DNA, 16 bp, Artificial sequence
  Synthetic oligonucleotide
gaggcttaaacttccc

SEQ ID NO: 613 - DNA, 16 bp, Artificial sequence
  Synthetic oligonucleotide
gggcagcatggagctc

SEQ ID NO: 614 - DNA, 16 bp, Artificial sequence
  Synthetic oligonucleotide
agagtgggtgaggcat

SEQ ID NO: 615 - DNA, 16 bp, Artificial sequence
  Synthetic oligonucleotide
cgattttccttggtca

SEQ ID NO: 616 - DNA, 16 bp, Artificial sequence
  Synthetic oligonucleotide
tctctgatccctgcta

SEQ ID NO: 617 - DNA, 16 bp, Artificial sequence
  Synthetic oligonucleotide
cccgaggttgaaaaga

SEQ ID NO: 618 - DNA, 16 bp, Artificial sequence
  Synthetic oligonucleotide
gagatctcaccgtcaa

SEQ ID NO: 619 - DNA, 16 bp, Artificial sequence
  Synthetic oligonucleotide
aagccccatgcaggac

SEQ ID NO: 620 - DNA, 16 bp, Artificial sequence
  Synthetic oligonucleotide
catttgaggcacggct

SEQ ID NO: 621 - DNA, 16 bp, Artificial sequence
  Synthetic oligonucleotide
aggctattttatgggt

SEQ ID NO: 622 - DNA, 16 bp, Artificial sequence
  Synthetic oligonucleotide
gttaaggatcaaatgg

SEQ ID NO: 623 - DNA, 16 bp, Artificial sequence
  Synthetic oligonucleotide
ttacagagtcagcgat

SEQ ID NO: 624 - DNA, 16 bp, Artificial sequence
  Synthetic oligonucleotide
cagagatggtttgaat

SEQ ID NO: 625 - DNA, 16 bp, Artificial sequence
  Synthetic oligonucleotide
taggtaagggatcagg

SEQ ID NO: 626 - DNA, 16 bp, Artificial sequence
  Synthetic oligonucleotide
ggcgaggctcctgaga

SEQ ID NO: 627 - DNA, 16 bp, Artificial sequence
  Synthetic oligonucleotide
tttttttcgatgagtg

SEQ ID NO: 628 - DNA, 16 bp, Artificial sequence
  Synthetic oligonucleotide
gaagtggactgacaga

SEQ ID NO: 629 - DNA, 16 bp, Artificial sequence
  Synthetic oligonucleotide
cggccctggaaggttc

SEQ ID NO: 630 - DNA, 16 bp, Artificial sequence
  Synthetic oligonucleotide
ggaggagtgcctgtaa

SEQ ID NO: 631 - DNA, 16 bp, Artificial sequence
  Synthetic oligonucleotide
aggccgggccttgagg

SEQ ID NO: 632 - DNA, 16 bp, Artificial sequence
  Synthetic oligonucleotide
accttctcacatccgg

SEQ ID NO: 633 - DNA, 16 bp, Artificial sequence
  Synthetic oligonucleotide
agactgtaccatctct

SEQ ID NO: 634 - DNA, 16 bp, Artificial sequence
  Synthetic oligonucleotide
ccggacagcaaacagg

SEQ ID NO: 635 - DNA, 16 bp, Artificial sequence
  Synthetic oligonucleotide
tccgctgcttctctgg

SEQ ID NO: 636 - DNA, 16 bp, Artificial sequence
  Synthetic oligonucleotide
tggaacacctgctggg

SEQ ID NO: 637 - DNA, 16 bp, Artificial sequence
  Synthetic oligonucleotide
gcaagacagtggaaac

SEQ ID NO: 638 - DNA, 16 bp, Artificial sequence
  Synthetic oligonucleotide
ggcaggctctctgtgt

SEQ ID NO: 639 - DNA, 16 bp, Artificial sequence
  Synthetic oligonucleotide
ctgtgtaggcctctgg

SEQ ID NO: 640 - DNA, 16 bp, Artificial sequence
  Synthetic oligonucleotide
gagtgaggtgagtggc

SEQ ID NO: 641 - DNA, 16 bp, Artificial sequence
  Synthetic oligonucleotide
gaggatccttcccagc

SEQ ID NO: 642 - DNA, 16 bp, Artificial sequence
  Synthetic oligonucleotide
cactttgagctgcgat

SEQ ID NO: 643 - DNA, 16 bp, Artificial sequence
  Synthetic oligonucleotide
tcaccttggtgaagtg

SEQ ID NO: 644 - DNA, 16 bp, Artificial sequence
  Synthetic oligonucleotide
gaccttacctggctgg

SEQ ID NO: 645 - DNA, 16 bp, Artificial sequence
  Synthetic oligonucleotide
attttcagttgcacct

SEQ ID NO: 646 - DNA, 16 bp, Artificial sequence
  Synthetic oligonucleotide
aaggagatcgatggag

SEQ ID NO: 647 - DNA, 16 bp, Artificial sequence
  Synthetic oligonucleotide
cagaactgatgctcac

SEQ ID NO: 648 - DNA, 16 bp, Artificial sequence
  Synthetic oligonucleotide
cctctaaagcgataca

SEQ ID NO: 649 - DNA, 16 bp, Artificial sequence
  Synthetic oligonucleotide
agaatcgagctcaccc

SEQ ID NO: 650 - DNA, 16 bp, Artificial sequence
  Synthetic oligonucleotide
caacaatcggcacttg

SEQ ID NO: 651 - DNA, 16 bp, Artificial sequence
  Synthetic oligonucleotide
agggagcataaaatag

SEQ ID NO: 652 - DNA, 16 bp, Artificial sequence
  Synthetic oligonucleotide
acaccctattaggagt

SEQ ID NO: 653 - DNA, 16 bp, Artificial sequence
  Synthetic oligonucleotide
aaccatcataagcatc

SEQ ID NO: 654 - DNA, 16 bp, Artificial sequence
  Synthetic oligonucleotide
ctcttaacctctatag

SEQ ID NO: 655 - DNA, 16 bp, Artificial sequence
  Synthetic oligonucleotide
gctgatcttgggttta

SEQ ID NO: 656 - DNA, 16 bp, Artificial sequence
  Synthetic oligonucleotide
tgagtgaatagtcagt

SEQ ID NO: 657 - DNA, 16 bp, Artificial sequence
  Synthetic oligonucleotide
gtattgcaaagcaaca

SEQ ID NO: 658 - DNA, 16 bp, Artificial sequence
  Synthetic oligonucleotide
gaacaagagatagtga

SEQ ID NO: 659 - DNA, 16 bp, Artificial sequence
  Synthetic oligonucleotide
ttaagtcattaggtgt

SEQ ID NO: 660 - DNA, 16 bp, Artificial sequence
  Synthetic oligonucleotide
agtcctgagatctagg

SEQ ID NO: 661 - DNA, 16 bp, Artificial sequence
  Synthetic oligonucleotide
agcctgactgactgac

SEQ ID NO: 662 - DNA, 16 bp, Artificial sequence
  Synthetic oligonucleotide
ccctagggcctcagtc

SEQ ID NO: 663 - DNA, 16 bp, Artificial sequence
  Synthetic oligonucleotide
tagtataacaccagga

SEQ ID NO: 664 - DNA, 16 bp, Artificial sequence
  Synthetic oligonucleotide
tatgacaagcccctag

SEQ ID NO: 665 - DNA, 16 bp, Artificial sequence
  Synthetic oligonucleotide
gtcatggcggccggat

SEQ ID NO: 666 - DNA, 16 bp, Artificial sequence
  Synthetic oligonucleotide
gggcagccggcttcct

SEQ ID NO: 667 - DNA, 16 bp, Artificial sequence
  Synthetic oligonucleotide
acacttggccagagct

SEQ ID NO: 668 - DNA, 16 bp, Artificial sequence
  Synthetic oligonucleotide
acaggagtgtgggtct

SEQ ID NO: 669 - DNA, 16 bp, Artificial sequence
  Synthetic oligonucleotide
cagcactgagttgggc

SEQ ID NO: 670 - DNA, 16 bp, Artificial sequence
  Synthetic oligonucleotide
taatcctggtctgaga

SEQ ID NO: 671 - DNA, 16 bp, Artificial sequence
  Synthetic oligonucleotide
cccaatttctggccct

SEQ ID NO: 672 - DNA, 16 bp, Artificial sequence
  Synthetic oligonucleotide
gggcaaggaggcgagt

SEQ ID NO: 673 - DNA, 16 bp, Artificial sequence
  Synthetic oligonucleotide
gctggaaggaccgagc

SEQ ID NO: 674 - DNA, 16 bp, Artificial sequence
  Synthetic oligonucleotide
gaatgggctggtggca

SEQ ID NO: 675 - DNA, 16 bp, Artificial sequence
  Synthetic oligonucleotide
tttcaagcctcaggcc

SEQ ID NO: 676 - DNA, 16 bp, Artificial sequence
  Synthetic oligonucleotide
ccccatagttgcaccc

SEQ ID NO: 677 - DNA, 16 bp, Artificial sequence
  Synthetic oligonucleotide
aaggtcggcacctgta

SEQ ID NO: 678 - DNA, 16 bp, Artificial sequence
  Synthetic oligonucleotide
acacatagctatgctc

SEQ ID NO: 679 - DNA, 16 bp, Artificial sequence
  Synthetic oligonucleotide
caaatactctgcactg

SEQ ID NO: 680 - DNA, 16 bp, Artificial sequence
  Synthetic oligonucleotide
atagcctacactgctc

SEQ ID NO: 681 - DNA, 16 bp, Artificial sequence
  Synthetic oligonucleotide
actagctttgtaaagc

SEQ ID NO: 682 - DNA, 16 bp, Artificial sequence
  Synthetic oligonucleotide
ctggcagagaagctta

SEQ ID NO: 683 - DNA, 16 bp, Artificial sequence
  Synthetic oligonucleotide
tcttactacttattgg

SEQ ID NO: 684 - DNA, 16 bp, Artificial sequence
  Synthetic oligonucleotide
catgaggagtagcagg

SEQ ID NO: 685 - DNA, 16 bp, Artificial sequence
  Synthetic oligonucleotide
gctgctaagggttgtg

SEQ ID NO: 686 - DNA, 16 bp, Artificial sequence
  Synthetic oligonucleotide
cattacctgctgctcc

SEQ ID NO: 687 - DNA, 16 bp, Artificial sequence
  Synthetic oligonucleotide
aaacatgaggcctcag

SEQ ID NO: 688 - DNA, 16 bp, Artificial sequence
  Synthetic oligonucleotide
gatcttagagtcagag

SEQ ID NO: 689 - DNA, 16 bp, Artificial sequence
  Synthetic oligonucleotide
gtacattcgcatcatg

SEQ ID NO: 690 - DNA, 16 bp, Artificial sequence
  Synthetic oligonucleotide
agaggcttaaacttcc

SEQ ID NO: 691 - DNA, 16 bp, Artificial sequence
  Synthetic oligonucleotide
cggatgcattttccca

SEQ ID NO: 692 - DNA, 16 bp, Artificial sequence
  Synthetic oligonucleotide
gtccagagtgggtgag

SEQ ID NO: 693 - DNA, 16 bp, Artificial sequence
  Synthetic oligonucleotide
ccgattttccttggtc

SEQ ID NO: 694 - DNA, 16 bp, Artificial sequence
  Synthetic oligonucleotide
tcaaggtctctgatcc

SEQ ID NO: 695 - DNA, 16 bp, Artificial sequence
  Synthetic oligonucleotide
tccccgaggttgaaaa

SEQ ID NO: 696 - DNA, 16 bp, Artificial sequence
  Synthetic oligonucleotide
ctgagatctcaccgtc

SEQ ID NO: 697 - DNA, 16 bp, Artificial sequence
  Synthetic oligonucleotide
atcaagccccatgcag

SEQ ID NO: 698 - DNA, 16 bp, Artificial sequence
  Synthetic oligonucleotide
acatttgaggcacggc

SEQ ID NO: 699 - DNA, 16 bp, Artificial sequence
  Synthetic oligonucleotide
tagggcaaggtgcaga

SEQ ID NO: 700 - DNA, 16 bp, Artificial sequence
  Synthetic oligonucleotide
agttaaggatcaaatg

SEQ ID NO: 701 - DNA, 16 bp, Artificial sequence
  Synthetic oligonucleotide
attacagagtcagcga

SEQ ID NO: 702 - DNA, 16 bp, Artificial sequence
  Synthetic oligonucleotide
ccagagatggtttgaa

SEQ ID NO: 703 - DNA, 16 bp, Artificial sequence
  Synthetic oligonucleotide
ttaggtaagggatcag

SEQ ID NO: 704 - DNA, 16 bp, Artificial sequence
  Synthetic oligonucleotide
cgtcatggcggccgga

SEQ ID NO: 705 - DNA, 16 bp, Artificial sequence
  Synthetic oligonucleotide
aatttttttcgatgag

SEQ ID NO: 706 - DNA, 16 bp, Artificial sequence
  Synthetic oligonucleotide
tgaagtggactgacag

SEQ ID NO: 707 - DNA, 16 bp, Artificial sequence
  Synthetic oligonucleotide
ctcggccctggaaggt

SEQ ID NO: 708 - DNA, 16 bp, Artificial sequence
  Synthetic oligonucleotide
tggaggagtgcctgta

SEQ ID NO: 709 - DNA, 16 bp, Artificial sequence
  Synthetic oligonucleotide
caggccgggccttgag

SEQ ID NO: 710 - DNA, 16 bp, Artificial sequence
  Synthetic oligonucleotide
aagaccttctcacatc

SEQ ID NO: 711 - DNA, 16 bp, Artificial sequence
  Synthetic oligonucleotide
gagactgtaccatctc

SEQ ID NO: 712 - DNA, 16 bp, Artificial sequence
  Synthetic oligonucleotide
tccggacagcaaacag

SEQ ID NO: 713 - DNA, 16 bp, Artificial sequence
  Synthetic oligonucleotide
gtgtccgctgcttctc

SEQ ID NO: 714 - DNA, 16 bp, Artificial sequence
  Synthetic oligonucleotide
ttggaacacctgctgg

SEQ ID NO: 715 - DNA, 16 bp, Artificial sequence
  Synthetic oligonucleotide
tgcagggctcgactgg

SEQ ID NO: 716 - DNA, 16 bp, Artificial sequence
  Synthetic oligonucleotide
gtactgaggcaggctc

SEQ ID NO: 717 - DNA, 16 bp, Artificial sequence
  Synthetic oligonucleotide
tctgtgtaggcctctg

SEQ ID NO: 718 - DNA, 16 bp, Artificial sequence
  Synthetic oligonucleotide
atggatcagggctcag

SEQ ID NO: 719 - DNA, 16 bp, Artificial sequence
  Synthetic oligonucleotide
cgaggatccttcccag

SEQ ID NO: 720 - DNA, 16 bp, Artificial sequence
  Synthetic oligonucleotide
ccactttgagctgcga

SEQ ID NO: 721 - DNA, 16 bp, Artificial sequence
  Synthetic oligonucleotide
ctcaccttggtgaagt

SEQ ID NO: 722 - DNA, 16 bp, Artificial sequence
  Synthetic oligonucleotide
agaccttacctggctg

SEQ ID NO: 723 - DNA, 16 bp, Artificial sequence
  Synthetic oligonucleotide
aattttcagttgcacc

SEQ ID NO: 724 - DNA, 16 bp, Artificial sequence
  Synthetic oligonucleotide
aaaggagatcgatgga

SEQ ID NO: 725 - DNA, 16 bp, Artificial sequence
  Synthetic oligonucleotide
aacagaactgatgctc

SEQ ID NO: 726 - DNA, 16 bp, Artificial sequence
  Synthetic oligonucleotide
tcctctaaagcgatac

SEQ ID NO: 727 - DNA, 16 bp, Artificial sequence
  Synthetic oligonucleotide
cagaatcgagctcacc

SEQ ID NO: 728 - DNA, 16 bp, Artificial sequence
  Synthetic oligonucleotide
tccaacaatcggcact

SEQ ID NO: 729 - DNA, 16 bp, Artificial sequence
  Synthetic oligonucleotide
agtagagggagcataa

SEQ ID NO: 730 - DNA, 16 bp, Artificial sequence
  Synthetic oligonucleotide
aacaccctattaggag

SEQ ID NO: 731 - DNA, 16 bp, Artificial sequence
  Synthetic oligonucleotide
ctatttgactgtataa

SEQ ID NO: 732 - DNA, 16 bp, Artificial sequence
  Synthetic oligonucleotide
gtacccacactcttaa

SEQ ID NO: 733 - DNA, 16 bp, Artificial sequence
  Synthetic oligonucleotide
taatgctgatcttggg

SEQ ID NO: 734 - DNA, 16 bp, Artificial sequence
  Synthetic oligonucleotide
attgagtgaatagtca

SEQ ID NO: 735 - DNA, 16 bp, Artificial sequence
  Synthetic oligonucleotide
attgtattgcaaagca

SEQ ID NO: 736 - DNA, 16 bp, Artificial sequence
  Synthetic oligonucleotide
cgagcaagagagaaca

SEQ ID NO: 737 - DNA, 16 bp, Artificial sequence
  Synthetic oligonucleotide
gttaagtcattaggtg

SEQ ID NO: 738 - DNA, 16 bp, Artificial sequence
  Synthetic oligonucleotide
gagtcctgagatctag

SEQ ID NO: 739 - DNA, 16 bp, Artificial sequence
  Synthetic oligonucleotide
aatcaaggttttcggg

SEQ ID NO: 740 - DNA, 16 bp, Artificial sequence
  Synthetic oligonucleotide
tccctagggcctcagt

SEQ ID NO: 741 - DNA, 16 bp, Artificial sequence
  Synthetic oligonucleotide
atagtataacaccagg

SEQ ID NO: 742 - DNA, 16 bp, Artificial sequence
  Synthetic oligonucleotide
ctatgacaagccccta

SEQ ID NO: 743 - DNA, 16 bp, Artificial sequence
  Synthetic oligonucleotide
ctgggcagccggcttc

SEQ ID NO: 744 - DNA, 16 bp, Artificial sequence
  Synthetic oligonucleotide
gacacttggccagagc

SEQ ID NO: 745 - DNA, 16 bp, Artificial sequence
  Synthetic oligonucleotide
aacaggagtgtgggtc

SEQ ID NO: 746 - DNA, 16 bp, Artificial sequence
  Synthetic oligonucleotide
tcacagcactgagttg

SEQ ID NO: 747 - DNA, 16 bp, Artificial sequence
  Synthetic oligonucleotide
tataatcctggtctga

SEQ ID NO: 748 - DNA, 16 bp, Artificial sequence
  Synthetic oligonucleotide
ccccaatttctggccc

SEQ ID NO: 749 - DNA, 16 bp, Artificial sequence
  Synthetic oligonucleotide
cagggcaaggaggcga

SEQ ID NO: 750 - DNA, 16 bp, Artificial sequence
  Synthetic oligonucleotide
agctggaaggaccgag

SEQ ID NO: 751 - DNA, 16 bp, Artificial sequence
  Synthetic oligonucleotide
acagaatgggctggtg

SEQ ID NO: 752 - DNA, 16 bp, Artificial sequence
  Synthetic oligonucleotide
gctgtttcaagcctca

SEQ ID NO: 753 - DNA, 16 bp, Artificial sequence
  Synthetic oligonucleotide
ggacatgtcccgaggg

SEQ ID NO: 754 - DNA, 16 bp, Artificial sequence
  Synthetic oligonucleotide
aaaggtcggcacctgt

SEQ ID NO: 755 - DNA, 16 bp, Artificial sequence
  Synthetic oligonucleotide
gacacatagctatgct

SEQ ID NO: 756 - DNA, 16 bp, Artificial sequence
  Synthetic oligonucleotide
ttcaaatactctgcac

SEQ ID NO: 757 - DNA, 16 bp, Artificial sequence
  Synthetic oligonucleotide
aatagcctacactgct

SEQ ID NO: 758 - DNA, 16 bp, Artificial sequence
  Synthetic oligonucleotide
gactagctttgtaaag

SEQ ID NO: 759 - DNA, 16 bp, Artificial sequence
  Synthetic oligonucleotide
cgaaaaccctgactcc

SEQ ID NO: 760 - DNA, 16 bp, Artificial sequence
  Synthetic oligonucleotide
atcttactacttattg

SEQ ID NO: 761 - DNA, 16 bp, Artificial sequence
  Synthetic oligonucleotide
gcatgaggagtagcag

SEQ ID NO: 762 - DNA, 16 bp, Artificial sequence
  Synthetic oligonucleotide
gtgcaaaggcctggct

SEQ ID NO: 763 - DNA, 16 bp, Artificial sequence
  Synthetic oligonucleotide
tggcattacctgctgc

SEQ ID NO: 764 - DNA, 16 bp, Artificial sequence
  Synthetic oligonucleotide
caaacatgaggcctca

SEQ ID NO: 765 - DNA, 16 bp, Artificial sequence
  Synthetic oligonucleotide
gatcacagtgtttggg

SEQ ID NO: 766 - DNA, 16 bp, Artificial sequence
  Synthetic oligonucleotide
taaacccccctggcct

SEQ ID NO: 767 - DNA, 16 bp, Artificial sequence
  Synthetic oligonucleotide
ccagaggcttaaactt

SEQ ID NO: 768 - DNA, 16 bp, Artificial sequence
  Synthetic oligonucleotide
gagcggatgcattttc

SEQ ID NO: 769 - DNA, 16 bp, Artificial sequence
  Synthetic oligonucleotide
gtagctggagtccaga

SEQ ID NO: 770 - DNA, 16 bp, Artificial sequence
  Synthetic oligonucleotide
cccgattttccttggt

SEQ ID NO: 771 - DNA, 16 bp, Artificial sequence
  Synthetic oligonucleotide
gtcaaggtctctgatc

SEQ ID NO: 772 - DNA, 16 bp, Artificial sequence
  Synthetic oligonucleotide
aatagttctccccgag

SEQ ID NO: 773 - DNA, 16 bp, Artificial sequence
  Synthetic oligonucleotide
cctgagatctcaccgt

SEQ ID NO: 774 - DNA, 16 bp, Artificial sequence
  Synthetic oligonucleotide
aatcaagccccatgca

SEQ ID NO: 775 - DNA, 16 bp, Artificial sequence
  Synthetic oligonucleotide
tgcggacaggtttggg

SEQ ID NO: 776 - DNA, 16 bp, Artificial sequence
  Synthetic oligonucleotide
tttagggcaaggtgca

SEQ ID NO: 777 - DNA, 16 bp, Artificial sequence
  Synthetic oligonucleotide
aagttaaggatcaaat

SEQ ID NO: 778 - DNA, 16 bp, Artificial sequence
  Synthetic oligonucleotide
gattacagagtcagcg

SEQ ID NO: 779 - DNA, 16 bp, Artificial sequence
  Synthetic oligonucleotide
tttaggtcagaagcca

SEQ ID NO: 780 - DNA, 16 bp, Artificial sequence
  Synthetic oligonucleotide
attaggtaagggatca

SEQ ID NO: 781 - DNA, 16 bp, Artificial sequence
  Synthetic oligonucleotide
caaatttttttcgatg

SEQ ID NO: 782 - DNA, 16 bp, Artificial sequence
  Synthetic oligonucleotide
tggtgaagtggactga

SEQ ID NO: 783 - DNA, 16 bp, Artificial sequence
  Synthetic oligonucleotide
tctcggccctggaagg

SEQ ID NO: 784 - DNA, 16 bp, Artificial sequence
  Synthetic oligonucleotide
ctggaggagtgcctgt

SEQ ID NO: 785 - DNA, 16 bp, Artificial sequence
  Synthetic oligonucleotide
tgatcccaggtgggag

SEQ ID NO: 786 - DNA, 16 bp, Artificial sequence
  Synthetic oligonucleotide
cgaagaccttctcaca

SEQ ID NO: 787 - DNA, 16 bp, Artificial sequence
  Synthetic oligonucleotide
tccagagactgtacca

SEQ ID NO: 788 - DNA, 16 bp, Artificial sequence
  Synthetic oligonucleotide
ctccggacagcaaaca

SEQ ID NO: 789 - DNA, 16 bp, Artificial sequence
  Synthetic oligonucleotide
gagtgtccgctgcttc

SEQ ID NO: 790 - DNA, 16 bp, Artificial sequence
  Synthetic oligonucleotide
gggttggaacacctgc

SEQ ID NO: 791 - DNA, 16 bp, Artificial sequence
  Synthetic oligonucleotide
gctgcagggctcgact

SEQ ID NO: 792 - DNA, 16 bp, Artificial sequence
  Synthetic oligonucleotide
tgtactgaggcaggct

SEQ ID NO: 793 - DNA, 16 bp, Artificial sequence
  Synthetic oligonucleotide
cgctgcttctgtgtag

SEQ ID NO: 794 - DNA, 16 bp, Artificial sequence
  Synthetic oligonucleotide
catggatcagggctca

SEQ ID NO: 795 - DNA, 16 bp, Artificial sequence
  Synthetic oligonucleotide
gcgaggatccttccca

SEQ ID NO: 796 - DNA, 16 bp, Artificial sequence
  Synthetic oligonucleotide
cccactttgagctgcg

SEQ ID NO: 797 - DNA, 16 bp, Artificial sequence
  Synthetic oligonucleotide
actcaccttggtgaag

SEQ ID NO: 798 - DNA, 16 bp, Artificial sequence
  Synthetic oligonucleotide
aagaccttacctggct

SEQ ID NO: 799 - DNA, 16 bp, Artificial sequence
  Synthetic oligonucleotide
catcaagagctaagag

SEQ ID NO: 800 - DNA, 16 bp, Artificial sequence
  Synthetic oligonucleotide
gaaaggagatcgatgg

SEQ ID NO: 801 - DNA, 16 bp, Artificial sequence
  Synthetic oligonucleotide
tgaacagaactgatgc

SEQ ID NO: 802 - DNA, 16 bp, Artificial sequence
  Synthetic oligonucleotide
aagggtctcctctaaa

SEQ ID NO: 803 - DNA, 16 bp, Artificial sequence
  Synthetic oligonucleotide
gcagaatcgagctcac

SEQ ID NO: 804 - DNA, 16 bp, Artificial sequence
  Synthetic oligonucleotide
gtccaacaatcggcac

SEQ ID NO: 805 - DNA, 16 bp, Artificial sequence
  Synthetic oligonucleotide
aagtagagggagcata

SEQ ID NO: 806 - DNA, 16 bp, Artificial sequence
  Synthetic oligonucleotide
gaacaccctattagga

SEQ ID NO: 807 - DNA, 16 bp, Artificial sequence
  Synthetic oligonucleotide
acctatttgactgtat

SEQ ID NO: 808 - DNA, 16 bp, Artificial sequence
  Synthetic oligonucleotide
agtacccacactctta

SEQ ID NO: 809 - DNA, 16 bp, Artificial sequence
  Synthetic oligonucleotide
ctaatgctgatcttgg

SEQ ID NO: 810 - DNA, 16 bp, Artificial sequence
  Synthetic oligonucleotide
ttattgagtgaatagt

SEQ ID NO: 811 - DNA, 16 bp, Artificial sequence
  Synthetic oligonucleotide
gaattgtattgcaaag

SEQ ID NO: 812 - DNA, 16 bp, Artificial sequence
  Synthetic oligonucleotide
gcgagcaagagagaac

SEQ ID NO: 813 - DNA, 16 bp, Artificial sequence
  Synthetic oligonucleotide
ggttaagtcattaggt

SEQ ID NO: 814 - DNA, 16 bp, Artificial sequence
  Synthetic oligonucleotide
tagagtcctgagatct

SEQ ID NO: 815 - DNA, 16 bp, Artificial sequence
  Synthetic oligonucleotide
cacaatcaaggttttc

SEQ ID NO: 816 - DNA, 16 bp, Artificial sequence
  Synthetic oligonucleotide
tagggcctcttgccta

SEQ ID NO: 817 - DNA, 16 bp, Artificial sequence
  Synthetic oligonucleotide
aatagtataacaccag

SEQ ID NO: 818 - DNA, 16 bp, Artificial sequence
  Synthetic oligonucleotide
ccactatgacaagccc

SEQ ID NO: 819 - DNA, 16 bp, Artificial sequence
  Synthetic oligonucleotide
atttttccgccattga

SEQ ID NO: 820 - DNA, 16 bp, Artificial sequence
  Synthetic oligonucleotide
ggacctagagggccgg

SEQ ID NO: 821 - DNA, 16 bp, Artificial sequence
  Synthetic oligonucleotide
ggacacttggccagag

SEQ ID NO: 822 - DNA, 16 bp, Artificial sequence
  Synthetic oligonucleotide
cgtgagaaacaggagt

SEQ ID NO: 823 - DNA, 16 bp, Artificial sequence
  Synthetic oligonucleotide
ccgttccacctcacag

SEQ ID NO: 824 - DNA, 16 bp, Artificial sequence
  Synthetic oligonucleotide
ctataatcctggtctg

SEQ ID NO: 825 - DNA, 16 bp, Artificial sequence
  Synthetic oligonucleotide
tcagagttcaccccaa

SEQ ID NO: 826 - DNA, 16 bp, Artificial sequence
  Synthetic oligonucleotide
tcagggcaaggaggcg

SEQ ID NO: 827 - DNA, 16 bp, Artificial sequence
  Synthetic oligonucleotide
cagctggaaggaccga

SEQ ID NO: 828 - DNA, 16 bp, Artificial sequence
  Synthetic oligonucleotide
cacagaatgggctggt

SEQ ID NO: 829 - DNA, 16 bp, Artificial sequence
  Synthetic oligonucleotide
cttgagagctgtttca

SEQ ID NO: 830 - DNA, 16 bp, Artificial sequence
  Synthetic oligonucleotide
tgggacatgtcccgag

SEQ ID NO: 831 - DNA, 16 bp, Artificial sequence
  Synthetic oligonucleotide
taaaggtcggcacctg

SEQ ID NO: 832 - DNA, 16 bp, Artificial sequence
  Synthetic oligonucleotide
ggacacatagctatgc

SEQ ID NO: 833 - DNA, 16 bp, Artificial sequence
  Synthetic oligonucleotide
gaggccatcctgatcc

SEQ ID NO: 834 - DNA, 16 bp, Artificial sequence
  Synthetic oligonucleotide
gaatagcctacactgc

SEQ ID NO: 835 - DNA, 16 bp, Artificial sequence
  Synthetic oligonucleotide
ttgactagctttgtaa

SEQ ID NO: 836 - DNA, 16 bp, Artificial sequence
  Synthetic oligonucleotide
tcgaaaaccctgactc

SEQ ID NO: 837 - DNA, 16 bp, Artificial sequence
  Synthetic oligonucleotide
gtttagctcttgcatc

SEQ ID NO: 838 - DNA, 16 bp, Artificial sequence
  Synthetic oligonucleotide
ttggcatgaggagtag

SEQ ID NO: 839 - DNA, 16 bp, Artificial sequence
  Synthetic oligonucleotide
ggacggcctgtgcaaa

SEQ ID NO: 840 - DNA, 16 bp, Artificial sequence
  Synthetic oligonucleotide
ctggcattacctgctg

SEQ ID NO: 841 - DNA, 16 bp, Artificial sequence
  Synthetic oligonucleotide
acaaacatgaggcctc

SEQ ID NO: 842 - DNA, 16 bp, Artificial sequence
  Synthetic oligonucleotide
tcaggatcacagtgtt

SEQ ID NO: 843 - DNA, 16 bp, Artificial sequence
  Synthetic oligonucleotide
ctaaacccccctggcc

SEQ ID NO: 844 - DNA, 16 bp, Artificial sequence
  Synthetic oligonucleotide
cccagaggcttaaact

SEQ ID NO: 845 - DNA, 16 bp, Artificial sequence
  Synthetic oligonucleotide
tgagcggatgcatttt

SEQ ID NO: 846 - DNA, 16 bp, Artificial sequence
  Synthetic oligonucleotide
tagtagctggagtcca

SEQ ID NO: 847 - DNA, 16 bp, Artificial sequence
  Synthetic oligonucleotide
ccccgattttccttgg

SEQ ID NO: 848 - DNA, 16 bp, Artificial sequence
  Synthetic oligonucleotide
agtcaaggtctctgat

SEQ ID NO: 849 - DNA, 16 bp, Artificial sequence
  Synthetic oligonucleotide
aaatagttctccccga

SEQ ID NO: 850 - DNA, 16 bp, Artificial sequence
  Synthetic oligonucleotide
gcctgagatctcaccg

SEQ ID NO: 851 - DNA, 16 bp, Artificial sequence
  Synthetic oligonucleotide
gaatcaagccccatgc

SEQ ID NO: 852 - DNA, 16 bp, Artificial sequence
  Synthetic oligonucleotide
gatttgcggacaggtt

SEQ ID NO: 853 - DNA, 16 bp, Artificial sequence
  Synthetic oligonucleotide
gtttagggcaaggtgc

SEQ ID NO: 854 - DNA, 16 bp, Artificial sequence
  Synthetic oligonucleotide
tgaagttaaggatcaa

SEQ ID NO: 855 - DNA, 16 bp, Artificial sequence
  Synthetic oligonucleotide
atgggattacagagtc

SEQ ID NO: 856 - DNA, 16 bp, Artificial sequence
  Synthetic oligonucleotide
ctttaggtcagaagcc

SEQ ID NO: 857 - DNA, 16 bp, Artificial sequence
  Synthetic oligonucleotide
gattaggtaagggatc

SEQ ID NO: 858 - DNA, 16 bp, Artificial sequence
  Synthetic oligonucleotide
ttttcgatgagtgtgt

SEQ ID NO: 859 - DNA, 16 bp, Artificial sequence
  Synthetic oligonucleotide
agcctggcttgtggga

SEQ ID NO: 860 - DNA, 16 bp, Artificial sequence
  Synthetic oligonucleotide
cctggaaggttccccc

SEQ ID NO: 861 - DNA, 16 bp, Artificial sequence
  Synthetic oligonucleotide
tgccccggagggtgcc

SEQ ID NO: 862 - DNA, 16 bp, Artificial sequence
  Synthetic oligonucleotide
gaagaccccagtggcg

SEQ ID NO: 863 - DNA, 16 bp, Artificial sequence
  Synthetic oligonucleotide
catttgccagcagtgg

SEQ ID NO: 864 - DNA, 16 bp, Artificial sequence
  Synthetic oligonucleotide
tggaggagacattgtg

SEQ ID NO: 865 - DNA, 16 bp, Artificial sequence
  Synthetic oligonucleotide
gaccaggctgggacga

SEQ ID NO: 866 - DNA, 16 bp, Artificial sequence
  Synthetic oligonucleotide
tcgcatgttgtggaac

SEQ ID NO: 867 - DNA, 16 bp, Artificial sequence
  Synthetic oligonucleotide
ggctccgtttcttgcg

SEQ ID NO: 868 - DNA, 16 bp, Artificial sequence
  Synthetic oligonucleotide
acagtggaaacctcac

SEQ ID NO: 869 - DNA, 16 bp, Artificial sequence
  Synthetic oligonucleotide
tgagggacaggattgt

SEQ ID NO: 870 - DNA, 16 bp, Artificial sequence
  Synthetic oligonucleotide
taggcctctgggcaca

SEQ ID NO: 871 - DNA, 16 bp, Artificial sequence
  Synthetic oligonucleotide
ttttggcaaggcagtg

SEQ ID NO: 872 - DNA, 16 bp, Artificial sequence
  Synthetic oligonucleotide
ccactgacctgtcctt

SEQ ID NO: 873 - DNA, 16 bp, Artificial sequence
  Synthetic oligonucleotide
gctgcgatggcacttg

SEQ ID NO: 874 - DNA, 16 bp, Artificial sequence
  Synthetic oligonucleotide
cttacctggctggaat

SEQ ID NO: 875 - DNA, 16 bp, Artificial sequence
  Synthetic oligonucleotide
ggacagcatttcaagt

SEQ ID NO: 876 - DNA, 16 bp, Artificial sequence
  Synthetic oligonucleotide
gagatcgatggagtgt

SEQ ID NO: 877 - DNA, 16 bp, Artificial sequence
  Synthetic oligonucleotide
gctcactctcataaaa

SEQ ID NO: 878 - DNA, 16 bp, Artificial sequence
  Synthetic oligonucleotide
ctaaagcgatacaagc

SEQ ID NO: 879 - DNA, 16 bp, Artificial sequence
  Synthetic oligonucleotide
atcgagctcaccccag

SEQ ID NO: 880 - DNA, 16 bp, Artificial sequence
  Synthetic oligonucleotide
caatcggcacttggtc

SEQ ID NO: 881 - DNA, 16 bp, Artificial sequence
  Synthetic oligonucleotide
aaataggacaaccttt

SEQ ID NO: 882 - DNA, 16 bp, Artificial sequence
  Synthetic oligonucleotide
ccctattaggagtaag

SEQ ID NO: 883 - DNA, 16 bp, Artificial sequence
  Synthetic oligonucleotide
ctatatatgtaatggc

SEQ ID NO: 884 - DNA, 16 bp, Artificial sequence
  Synthetic oligonucleotide
ttaacctctatagtaa

SEQ ID NO: 885 - DNA, 16 bp, Artificial sequence
  Synthetic oligonucleotide
atcttgggtttattgt

SEQ ID NO: 886 - DNA, 16 bp, Artificial sequence
  Synthetic oligonucleotide
tgaatagtcagtccat

SEQ ID NO: 887 - DNA, 16 bp, Artificial sequence
  Synthetic oligonucleotide
cagaatagaaagcttg

SEQ ID NO: 888 - DNA, 16 bp, Artificial sequence
  Synthetic oligonucleotide
ggagagccagagtgca

SEQ ID NO: 889 - DNA, 16 bp, Artificial sequence
  Synthetic oligonucleotide
gtcattaggtgtctgc

SEQ ID NO: 890 - DNA, 16 bp, Artificial sequence
  Synthetic oligonucleotide
ctgagatctaggcttg

SEQ ID NO: 891 - DNA, 16 bp, Artificial sequence
  Synthetic oligonucleotide
catcatcaccacgctc

SEQ ID NO: 892 - DNA, 16 bp, Artificial sequence
  Synthetic oligonucleotide
tcccaaatacatggcc

SEQ ID NO: 893 - DNA, 16 bp, Artificial sequence
  Synthetic oligonucleotide
tataacaccaggacct

SEQ ID NO: 894 - DNA, 16 bp, Artificial sequence
  Synthetic oligonucleotide
ccctagctctgaagac

SEQ ID NO: 895 - DNA, 16 bp, Artificial sequence
  Synthetic oligonucleotide
gccggatgcgccgggc

SEQ ID NO: 896 - DNA, 16 bp, Artificial sequence
  Synthetic oligonucleotide
cggcttcctgcactgt

SEQ ID NO: 897 - DNA, 16 bp, Artificial sequence
  Synthetic oligonucleotide
gccagagctaagaatt

SEQ ID NO: 898 - DNA, 16 bp, Artificial sequence
  Synthetic oligonucleotide
tccgaacaagggcctg

SEQ ID NO: 899 - DNA, 16 bp, Artificial sequence
  Synthetic oligonucleotide
ggagtatagaagggtt

SEQ ID NO: 900 - DNA, 16 bp, Artificial sequence
  Synthetic oligonucleotide
ctggaagggactgccc

SEQ ID NO: 901 - DNA, 16 bp, Artificial sequence
  Synthetic oligonucleotide
cctcaaatgcccactc

SEQ ID NO: 902 - DNA, 16 bp, Artificial sequence
  Synthetic oligonucleotide
caaggaggcgagtcca

SEQ ID NO: 903 - DNA, 16 bp, Artificial sequence
  Synthetic oligonucleotide
ggaaggaccgagctga

SEQ ID NO: 904 - DNA, 16 bp, Artificial sequence
  Synthetic oligonucleotide
aaggcgagaagtgggt

SEQ ID NO: 905 - DNA, 16 bp, Artificial sequence
  Synthetic oligonucleotide
tcggactttctcctcg

SEQ ID NO: 906 - DNA, 16 bp, Artificial sequence
  Synthetic oligonucleotide
gcagaggtccagcacc

SEQ ID NO: 907 - DNA, 16 bp, Artificial sequence
  Synthetic oligonucleotide
tcggcacctgtaggtc

SEQ ID NO: 908 - DNA, 16 bp, Artificial sequence
  Synthetic oligonucleotide
ctacaatacggcctcc

SEQ ID NO: 909 - DNA, 16 bp, Artificial sequence
  Synthetic oligonucleotide
gcactgcaagcccaca

SEQ ID NO: 910 - DNA, 16 bp, Artificial sequence
  Synthetic oligonucleotide
ggctgaggtgttacca

SEQ ID NO: 911 - DNA, 16 bp, Artificial sequence
  Synthetic oligonucleotide
gtaaagctctgtggtt

SEQ ID NO: 912 - DNA, 16 bp, Artificial sequence
  Synthetic oligonucleotide
aagcttaaagacggcc

SEQ ID NO: 913 - DNA, 16 bp, Artificial sequence
  Synthetic oligonucleotide
actacttattgggatg

SEQ ID NO: 914 - DNA, 16 bp, Artificial sequence
  Synthetic oligonucleotide
ggagtagcagggcaaa

SEQ ID NO: 915 - DNA, 16 bp, Artificial sequence
  Synthetic oligonucleotide
gctaagggttgtgtgt

SEQ ID NO: 916 - DNA, 16 bp, Artificial sequence
  Synthetic oligonucleotide
gcagtgcctaagtagg

SEQ ID NO: 917 - DNA, 16 bp, Artificial sequence
  Synthetic oligonucleotide
atgaggcctcagcctg

SEQ ID NO: 918 - DNA, 16 bp, Artificial sequence
  Synthetic oligonucleotide
tcagagggtttgtaag

SEQ ID NO: 919 - DNA, 16 bp, Artificial sequence
  Synthetic oligonucleotide
ttcgcatcatgagaaa

SEQ ID NO: 920 - DNA, 16 bp, Artificial sequence
  Synthetic oligonucleotide
ggcttaaacttcccac

SEQ ID NO: 921 - DNA, 16 bp, Artificial sequence
  Synthetic oligonucleotide
agcatggagctccttt

SEQ ID NO: 922 - DNA, 16 bp, Artificial sequence
  Synthetic oligonucleotide
tgaggcatggccccaa

SEQ ID NO: 923 - DNA, 16 bp, Artificial sequence
  Synthetic oligonucleotide
attttccttggtcagg

SEQ ID NO: 924 - DNA, 16 bp, Artificial sequence
  Synthetic oligonucleotide
tctgatccctgctaag

SEQ ID NO: 925 - DNA, 16 bp, Artificial sequence
  Synthetic oligonucleotide
gttgaaaagaagcgga

SEQ ID NO: 926 - DNA, 16 bp, Artificial sequence
  Synthetic oligonucleotide
tctcaccgtcaacacc

SEQ ID NO: 927 - DNA, 16 bp, Artificial sequence
  Synthetic oligonucleotide
catgcaggacctccta

SEQ ID NO: 928 - DNA, 16 bp, Artificial sequence
  Synthetic oligonucleotide
tgggaatggaggaacc

SEQ ID NO: 929 - DNA, 16 bp, Artificial sequence
  Synthetic oligonucleotide
attttatgggtccagg

SEQ ID NO: 930 - DNA, 16 bp, Artificial sequence
  Synthetic oligonucleotide
aaggatcaaatgggtg

SEQ ID NO: 931 - DNA, 16 bp, Artificial sequence
  Synthetic oligonucleotide
acagagtcagcgatga

SEQ ID NO: 932 - DNA, 16 bp, Artificial sequence
  Synthetic oligonucleotide
ttgaattatcgagtat

SEQ ID NO: 933 - DNA, 16 bp, Artificial sequence
  Synthetic oligonucleotide
ggtaagggatcaggac

SEQ ID NO: 934 - DNA, 16 bp, Artificial sequence
  Synthetic oligonucleotide
atccaaatttttttcg

SEQ ID NO: 935 - DNA, 16 bp, Artificial sequence
  Synthetic oligonucleotide
ttggtgaagtggactg

SEQ ID NO: 936 - DNA, 16 bp, Artificial sequence
  Synthetic oligonucleotide
atctcggccctggaag

SEQ ID NO: 937 - DNA, 16 bp, Artificial sequence
  Synthetic oligonucleotide
tcctggaggagtgcct

SEQ ID NO: 938 - DNA, 16 bp, Artificial sequence
  Synthetic oligonucleotide
gttgatcccaggtggg

SEQ ID NO: 939 - DNA, 16 bp, Artificial sequence
  Synthetic oligonucleotide
tcgaagaccttctcac

SEQ ID NO: 940 - DNA, 16 bp, Artificial sequence
  Synthetic oligonucleotide
cctgcatggcactcag

SEQ ID NO: 941 - DNA, 16 bp, Artificial sequence
  Synthetic oligonucleotide
cctccggacagcaaac

SEQ ID NO: 942 - DNA, 16 bp, Artificial sequence
  Synthetic oligonucleotide
attgagtgtccgctgc

SEQ ID NO: 943 - DNA, 16 bp, Artificial sequence
  Synthetic oligonucleotide
agggttggaacacctg

SEQ ID NO: 944 - DNA, 16 bp, Artificial sequence
  Synthetic oligonucleotide
tggctgcagggctcga

SEQ ID NO: 945 - DNA, 16 bp, Artificial sequence
  Synthetic oligonucleotide
agtgtactgaggcagg

SEQ ID NO: 946 - DNA, 16 bp, Artificial sequence
  Synthetic oligonucleotide
ctgagggtactgacgc

SEQ ID NO: 947 - DNA, 16 bp, Artificial sequence
  Synthetic oligonucleotide
gcatggatcagggctc

SEQ ID NO: 948 - DNA, 16 bp, Artificial sequence
  Synthetic oligonucleotide
ggcgaggatccttccc

SEQ ID NO: 949 - DNA, 16 bp, Artificial sequence
  Synthetic oligonucleotide
gcccactttgagctgc

SEQ ID NO: 950 - DNA, 16 bp, Artificial sequence
  Synthetic oligonucleotide
acactcaccttggtga

SEQ ID NO: 951 - DNA, 16 bp, Artificial sequence
  Synthetic oligonucleotide
aaagaccttacctggc

SEQ ID NO: 952 - DNA, 16 bp, Artificial sequence
  Synthetic oligonucleotide
gcatcaagagctaaga

SEQ ID NO: 953 - DNA, 16 bp, Artificial sequence
  Synthetic oligonucleotide
ggaaaggagatcgatg

SEQ ID NO: 954 - DNA, 16 bp, Artificial sequence
  Synthetic oligonucleotide
ggtgaacagaactgat

SEQ ID NO: 955 - DNA, 16 bp, Artificial sequence
  Synthetic oligonucleotide
caagggtctcctctaa

SEQ ID NO: 956 - DNA, 16 bp, Artificial sequence
  Synthetic oligonucleotide
ctgcagaatcgagctc

SEQ ID NO: 957 - DNA, 16 bp, Artificial sequence
  Synthetic oligonucleotide
gagaaacaaccggaat

SEQ ID NO: 958 - DNA, 16 bp, Artificial sequence
  Synthetic oligonucleotide
taagtagagggagcat

SEQ ID NO: 959 - DNA, 16 bp, Artificial sequence
  Synthetic oligonucleotide
atgaacaccctattag

SEQ ID NO: 960 - DNA, 16 bp, Artificial sequence
  Synthetic oligonucleotide
aacctatttgactgta

SEQ ID NO: 961 - DNA, 16 bp, Artificial sequence
  Synthetic oligonucleotide
cagtacccacactctt

SEQ ID NO: 962 - DNA, 16 bp, Artificial sequence
  Synthetic oligonucleotide
cctaatgctgatcttg

SEQ ID NO: 963 - DNA, 16 bp, Artificial sequence
  Synthetic oligonucleotide
gttattgagtgaatag

SEQ ID NO: 964 - DNA, 16 bp, Artificial sequence
  Synthetic oligonucleotide
gggtattgaattgtat

SEQ ID NO: 965 - DNA, 16 bp, Artificial sequence
  Synthetic oligonucleotide
caaagagcgagcaaga

SEQ ID NO: 966 - DNA, 16 bp, Artificial sequence
  Synthetic oligonucleotide
tggttaagtcattagg

SEQ ID NO: 967 - DNA, 16 bp, Artificial sequence
  Synthetic oligonucleotide
ctagagtcctgagatc

SEQ ID NO: 968 - DNA, 16 bp, Artificial sequence
  Synthetic oligonucleotide
ccacaatcaaggtttt

SEQ ID NO: 969 - DNA, 16 bp, Artificial sequence
  Synthetic oligonucleotide
atagggcctcttgcct

SEQ ID NO: 970 - DNA, 16 bp, Artificial sequence
  Synthetic oligonucleotide
caaatagtataacacc

SEQ ID NO: 971 - DNA, 16 bp, Artificial sequence
  Synthetic oligonucleotide
ccgagaactggctgcc

SEQ ID NO: 972 - DNA, 16 bp, Artificial sequence
  Synthetic oligonucleotide
gatttttccgccattg

SEQ ID NO: 973 - DNA, 16 bp, Artificial sequence
  Synthetic oligonucleotide
gaggacctagagggcc

SEQ ID NO: 974 - DNA, 16 bp, Artificial sequence
  Synthetic oligonucleotide
cctggacacttggcca

SEQ ID NO: 975 - DNA, 16 bp, Artificial sequence
  Synthetic oligonucleotide
ttagaacattactgcg

SEQ ID NO: 976 - DNA, 16 bp, Artificial sequence
  Synthetic oligonucleotide
taaactctctggtgtg

SEQ ID NO: 977 - DNA, 16 bp, Artificial sequence
  Synthetic oligonucleotide
cctataatcctggtct

SEQ ID NO: 978 - DNA, 16 bp, Artificial sequence
  Synthetic oligonucleotide
ccccatcagagttcac

SEQ ID NO: 979 - DNA, 16 bp, Artificial sequence
  Synthetic oligonucleotide
ctggatctcagggcaa

SEQ ID NO: 980 - DNA, 16 bp, Artificial sequence
  Synthetic oligonucleotide
gcagctggaaggaccg

SEQ ID NO: 981 - DNA, 16 bp, Artificial sequence
  Synthetic oligonucleotide
tgtaacagtcctggca

SEQ ID NO: 982 - DNA, 16 bp, Artificial sequence
  Synthetic oligonucleotide
ccacttgagagctgtt

SEQ ID NO: 983 - DNA, 16 bp, Artificial sequence
  Synthetic oligonucleotide
ctgggacatgtcccga

SEQ ID NO: 984 - DNA, 16 bp, Artificial sequence
  Synthetic oligonucleotide
gtaaaggtcggcacct

SEQ ID NO: 985 - DNA, 16 bp, Artificial sequence
  Synthetic oligonucleotide
acctacttggccccag

SEQ ID NO: 986 - DNA, 16 bp, Artificial sequence
  Synthetic oligonucleotide
tgagaggccatcctga

SEQ ID NO: 987 - DNA, 16 bp, Artificial sequence
  Synthetic oligonucleotide
agaatagcctacactg

SEQ ID NO: 988 - DNA, 16 bp, Artificial sequence
  Synthetic oligonucleotide
tttgactagctttgta

SEQ ID NO: 989 - DNA, 16 bp, Artificial sequence
  Synthetic oligonucleotide
cctcgaaaaccctgac

SEQ ID NO: 990 - DNA, 16 bp, Artificial sequence
  Synthetic oligonucleotide
gagtttagctcttgca

SEQ ID NO: 991 - DNA, 16 bp, Artificial sequence
  Synthetic oligonucleotide
atgttggcatgaggag

SEQ ID NO: 992 - DNA, 16 bp, Artificial sequence
  Synthetic oligonucleotide
gggacggcctgtgcaa

SEQ ID NO: 993 - DNA, 16 bp, Artificial sequence
  Synthetic oligonucleotide
cttaccctccaccgcc

SEQ ID NO: 994 - DNA, 16 bp, Artificial sequence
  Synthetic oligonucleotide
cacaaacatgaggcct

SEQ ID NO: 995 - DNA, 16 bp, Artificial sequence
  Synthetic oligonucleotide
ctcaggatcacagtgt

SEQ ID NO: 996 - DNA, 16 bp, Artificial sequence
  Synthetic oligonucleotide
cctaaacccccctggc

SEQ ID NO: 997 - DNA, 16 bp, Artificial sequence
  Synthetic oligonucleotide
acccagaggcttaaac

SEQ ID NO: 998 - DNA, 16 bp, Artificial sequence
  Synthetic oligonucleotide
gtgagcggatgcattt

SEQ ID NO: 999 - DNA, 16 bp, Artificial sequence
  Synthetic oligonucleotide
tatagtagctggagtc

SEQ ID NO: 1000 - DNA, 16 bp, Artificial sequence
  Synthetic oligonucleotide
accccgattttccttg

SEQ ID NO: 1001 - DNA, 16 bp, Artificial sequence
  Synthetic oligonucleotide
tgacagtcaaggtctc

SEQ ID NO: 1002 - DNA, 16 bp, Artificial sequence
  Synthetic oligonucleotide
aaaatagttctccccg

SEQ ID NO: 1003 - DNA, 16 bp, Artificial sequence
  Synthetic oligonucleotide
aggcctgagatctcac

SEQ ID NO: 1004 - DNA, 16 bp, Artificial sequence
  Synthetic oligonucleotide
tgaatcaagccccatg

SEQ ID NO: 1005 - DNA, 16 bp, Artificial sequence
  Synthetic oligonucleotide
ggatttgcggacaggt

SEQ ID NO: 1006 - DNA, 16 bp, Artificial sequence
  Synthetic oligonucleotide
cgtttagggcaaggtg

SEQ ID NO: 1007 - DNA, 16 bp, Artificial sequence
  Synthetic oligonucleotide
tgagatgaaggagttg

SEQ ID NO: 1008 - DNA, 16 bp, Artificial sequence
  Synthetic oligonucleotide
gaatgggattacagag

SEQ ID NO: 1009 - DNA, 16 bp, Artificial sequence
  Synthetic oligonucleotide
gctttaggtcagaagc

SEQ ID NO: 1010 - DNA, 16 bp, Artificial sequence
  Synthetic oligonucleotide
ggattaggtaagggat

SEQ ID NO: 1011 - DNA, 16 bp, Artificial sequence
  Synthetic oligonucleotide
cgcagacctctctctt

SEQ ID NO: 1012 - DNA, 16 bp, Artificial sequence
  Synthetic oligonucleotide
cttggtgaagtggact

SEQ ID NO: 1013 - DNA, 16 bp, Artificial sequence
  Synthetic oligonucleotide
gatctcggccctggaa

SEQ ID NO: 1014 - DNA, 16 bp, Artificial sequence
  Synthetic oligonucleotide
gtcctggaggagtgcc

SEQ ID NO: 1015 - DNA, 16 bp, Artificial sequence
  Synthetic oligonucleotide
gacacccattccaggc

SEQ ID NO: 1016 - DNA, 16 bp, Artificial sequence
  Synthetic oligonucleotide
ttcgaagaccttctca

SEQ ID NO: 1017 - DNA, 16 bp, Artificial sequence
  Synthetic oligonucleotide
gccttggtcagtgcca

SEQ ID NO: 1018 - DNA, 16 bp, Artificial sequence
  Synthetic oligonucleotide
gcctccggacagcaaa

SEQ ID NO: 1019 - DNA, 16 bp, Artificial sequence
  Synthetic oligonucleotide
tcattgagtgtccgct

SEQ ID NO: 1020 - DNA, 16 bp, Artificial sequence
  Synthetic oligonucleotide
tagggttggaacacct

SEQ ID NO: 1021 - DNA, 16 bp, Artificial sequence
  Synthetic oligonucleotide
ttggctgcagggctcg

SEQ ID NO: 1022 - DNA, 16 bp, Artificial sequence
  Synthetic oligonucleotide
gagtgtactgaggcag

SEQ ID NO: 1023 - DNA, 16 bp, Artificial sequence
  Synthetic oligonucleotide
cctgagggtactgacg

SEQ ID NO: 1024 - DNA, 16 bp, Artificial sequence
  Synthetic oligonucleotide
ggcatggatcagggct

SEQ ID NO: 1025 - DNA, 16 bp, Artificial sequence
  Synthetic oligonucleotide
gggcgaggatccttcc

SEQ ID NO: 1026 - DNA, 16 bp, Artificial sequence
  Synthetic oligonucleotide
tatgagcccagaccca

SEQ ID NO: 1027 - DNA, 16 bp, Artificial sequence
  Synthetic oligonucleotide
gacactcaccttggtg

SEQ ID NO: 1028 - DNA, 16 bp, Artificial sequence
  Synthetic oligonucleotide
taaagaccttacctgg

SEQ ID NO: 1029 - DNA, 16 bp, Artificial sequence
  Synthetic oligonucleotide
aggcatcaagagctaa

SEQ ID NO: 1030 - DNA, 16 bp, Artificial sequence
  Synthetic oligonucleotide
aggaaaggagatcgat

SEQ ID NO: 1031 - DNA, 16 bp, Artificial sequence
  Synthetic oligonucleotide
gggtgaacagaactga

SEQ ID NO: 1032 - DNA, 16 bp, Artificial sequence
  Synthetic oligonucleotide
ccaagggtctcctcta

SEQ ID NO: 1033 - DNA, 16 bp, Artificial sequence
  Synthetic oligonucleotide
cctgcagaatcgagct

SEQ ID NO: 1034 - DNA, 16 bp, Artificial sequence
  Synthetic oligonucleotide
cgagaaacaaccggaa

SEQ ID NO: 1035 - DNA, 16 bp, Artificial sequence
  Synthetic oligonucleotide
ttaagtagagggagca

SEQ ID NO: 1036 - DNA, 16 bp, Artificial sequence
  Synthetic oligonucleotide
gatgaacaccctatta

SEQ ID NO: 1037 - DNA, 16 bp, Artificial sequence
  Synthetic oligonucleotide
ctaacctatttgactg

SEQ ID NO: 1038 - DNA, 16 bp, Artificial sequence
  Synthetic oligonucleotide
ccagtacccacactct

SEQ ID NO: 1039 - DNA, 16 bp, Artificial sequence
  Synthetic oligonucleotide
acctaatgctgatctt

SEQ ID NO: 1040 - DNA, 16 bp, Artificial sequence
  Synthetic oligonucleotide
gataaagttattgagt

SEQ ID NO: 1041 - DNA, 16 bp, Artificial sequence
  Synthetic oligonucleotide
tgggtattgaattgta

SEQ ID NO: 1042 - DNA, 16 bp, Artificial sequence
  Synthetic oligonucleotide
acaaagagcgagcaag

SEQ ID NO: 1043 - DNA, 16 bp, Artificial sequence
  Synthetic oligonucleotide
ctggttaagtcattag

SEQ ID NO: 1044 - DNA, 16 bp, Artificial sequence
  Synthetic oligonucleotide
acctagagtcctgaga

SEQ ID NO: 1045 - DNA, 16 bp, Artificial sequence
  Synthetic oligonucleotide
ccccacaatcaaggtt

SEQ ID NO: 1046 - DNA, 16 bp, Artificial sequence
  Synthetic oligonucleotide
tcatagggcctcttgc

SEQ ID NO: 1047 - DNA, 16 bp, Artificial sequence
  Synthetic oligonucleotide
cttcaaatagtataac

SEQ ID NO: 1048 - DNA, 16 bp, Artificial sequence
  Synthetic oligonucleotide
tccgagaactggctgc

SEQ ID NO: 1049 - DNA, 16 bp, Artificial sequence
  Synthetic oligonucleotide
agatttttccgccatt

SEQ ID NO: 1050 - DNA, 16 bp, Artificial sequence
  Synthetic oligonucleotide
agaggacctagagggc

SEQ ID NO: 1051 - DNA, 16 bp, Artificial sequence
  Synthetic oligonucleotide
gcctggacacttggcc

SEQ ID NO: 1052 - DNA, 16 bp, Artificial sequence
  Synthetic oligonucleotide
cttagaacattactgc

SEQ ID NO: 1053 - DNA, 16 bp, Artificial sequence
  Synthetic oligonucleotide
taggaagtgtttccgt

SEQ ID NO: 1054 - DNA, 16 bp, Artificial sequence
  Synthetic oligonucleotide
tcctataatcctggtc

SEQ ID NO: 1055 - DNA, 16 bp, Artificial sequence
  Synthetic oligonucleotide
gtagaagcttctctac

SEQ ID NO: 1056 - DNA, 16 bp, Artificial sequence
  Synthetic oligonucleotide
ctggcattaaatatgt

SEQ ID NO: 1057 - DNA, 16 bp, Artificial sequence
  Synthetic oligonucleotide
tttagcttgagcagct

SEQ ID NO: 1058 - DNA, 16 bp, Artificial sequence
  Synthetic oligonucleotide
ttgtaacagtcctggc

SEQ ID NO: 1059 - DNA, 16 bp, Artificial sequence
  Synthetic oligonucleotide
tccacttgagagctgt

SEQ ID NO: 1060 - DNA, 16 bp, Artificial sequence
  Synthetic oligonucleotide
gctgggacatgtcccg

SEQ ID NO: 1061 - DNA, 16 bp, Artificial sequence
  Synthetic oligonucleotide
agtaaaggtcggcacc

SEQ ID NO: 1062 - DNA, 16 bp, Artificial sequence
  Synthetic oligonucleotide
cctcacctacttggcc

SEQ ID NO: 1063 - DNA, 16 bp, Artificial sequence
  Synthetic oligonucleotide
gtgagaggccatcctg

SEQ ID NO: 1064 - DNA, 16 bp, Artificial sequence
  Synthetic oligonucleotide
cagaatagcctacact

SEQ ID NO: 1065 - DNA, 16 bp, Artificial sequence
  Synthetic oligonucleotide
attttgactagctttg

SEQ ID NO: 1066 - DNA, 16 bp, Artificial sequence
  Synthetic oligonucleotide
gcctcgaaaaccctga

SEQ ID NO: 1067 - DNA, 16 bp, Artificial sequence
  Synthetic oligonucleotide
tctcagagtttagctc

SEQ ID NO: 1068 - DNA, 16 bp, Artificial sequence
  Synthetic oligonucleotide
catgttggcatgagga

SEQ ID NO: 1069 - DNA, 16 bp, Artificial sequence
  Synthetic oligonucleotide
gagggacggcctgtgc

SEQ ID NO: 1070 - DNA, 16 bp, Artificial sequence
  Synthetic oligonucleotide
ccttaccctccaccgc

SEQ ID NO: 1071 - DNA, 16 bp, Artificial sequence
  Synthetic oligonucleotide
gcacaaacatgaggcc

SEQ ID NO: 1072 - DNA, 16 bp, Artificial sequence
  Synthetic oligonucleotide
actcaggatcacagtg

SEQ ID NO: 1073 - DNA, 16 bp, Artificial sequence
  Synthetic oligonucleotide
acctaaacccccctgg

SEQ ID NO: 1074 - DNA, 16 bp, Artificial sequence
  Synthetic oligonucleotide
gtgacccagaggctta

SEQ ID NO: 1075 - DNA, 16 bp, Artificial sequence
  Synthetic oligonucleotide
tgtgagcggatgcatt

SEQ ID NO: 1076 - DNA, 16 bp, Artificial sequence
  Synthetic oligonucleotide
atatagtagctggagt

SEQ ID NO: 1077 - DNA, 16 bp, Artificial sequence
  Synthetic oligonucleotide
caccccgattttcctt

SEQ ID NO: 1078 - DNA, 16 bp, Artificial sequence
  Synthetic oligonucleotide
gatgacagtcaaggtc

SEQ ID NO: 1079 - DNA, 16 bp, Artificial sequence
  Synthetic oligonucleotide
caaaatagttctcccc

SEQ ID NO: 1080 - DNA, 16 bp, Artificial sequence
  Synthetic oligonucleotide
tacaggcctgagatct

SEQ ID NO: 1081 - DNA, 16 bp, Artificial sequence
  Synthetic oligonucleotide
gatgaatcaagcccca

SEQ ID NO: 1082 - DNA, 16 bp, Artificial sequence
  Synthetic oligonucleotide
gtggtttaggtttgga

SEQ ID NO: 1083 - DNA, 16 bp, Artificial sequence
  Synthetic oligonucleotide
tagagtaagagctggg

SEQ ID NO: 1084 - DNA, 16 bp, Artificial sequence
  Synthetic oligonucleotide
tctgagaaggcattgg

SEQ ID NO: 1085 - DNA, 16 bp, Artificial sequence
  Synthetic oligonucleotide
cagtttggattcagga

SEQ ID NO: 1086 - DNA, 16 bp, Artificial sequence
  Synthetic oligonucleotide
ggctttaggtcagaag

SEQ ID NO: 1087 - DNA, 16 bp, Artificial sequence
  Synthetic oligonucleotide
ctgggattaggtaagg

SEQ ID NO: 1088 - DNA, 16 bp, Artificial sequence
  Synthetic oligonucleotide
gccgcagacctctctc

SEQ ID NO: 1089 - DNA, 16 bp, Artificial sequence
  Synthetic oligonucleotide
ggcttggtgaagtgga

SEQ ID NO: 1090 - DNA, 16 bp, Artificial sequence
  Synthetic oligonucleotide
agatctcggccctgga

SEQ ID NO: 1091 - DNA, 16 bp, Artificial sequence
  Synthetic oligonucleotide
gcatgaaatgtggcct

SEQ ID NO: 1092 - DNA, 16 bp, Artificial sequence
  Synthetic oligonucleotide
ctggacacccattcca

SEQ ID NO: 1093 - DNA, 16 bp, Artificial sequence
  Synthetic oligonucleotide
cttcgaagaccttctc

SEQ ID NO: 1094 - DNA, 16 bp, Artificial sequence
  Synthetic oligonucleotide
agccttggtcagtgcc

SEQ ID NO: 1095 - DNA, 16 bp, Artificial sequence
  Synthetic oligonucleotide
cacaggtgcctccgga

SEQ ID NO: 1096 - DNA, 16 bp, Artificial sequence
  Synthetic oligonucleotide
ctcattgagtgtccgc

SEQ ID NO: 1097 - DNA, 16 bp, Artificial sequence
  Synthetic oligonucleotide
gtagggttggaacacc

SEQ ID NO: 1098 - DNA, 16 bp, Artificial sequence
  Synthetic oligonucleotide
tttggctgcagggctc

SEQ ID NO: 1099 - DNA, 16 bp, Artificial sequence
  Synthetic oligonucleotide
tgagtgtactgaggca

SEQ ID NO: 1100 - DNA, 16 bp, Artificial sequence
  Synthetic oligonucleotide
tcctgagggtactgac

SEQ ID NO: 1101 - DNA, 16 bp, Artificial sequence
  Synthetic oligonucleotide
gaggcatggatcaggg

SEQ ID NO: 1102 - DNA, 16 bp, Artificial sequence
  Synthetic oligonucleotide
agggcgaggatccttc

SEQ ID NO: 1103 - DNA, 16 bp, Artificial sequence
  Synthetic oligonucleotide
cctatgagcccagacc

SEQ ID NO: 1104 - DNA, 16 bp, Artificial sequence
  Synthetic oligonucleotide
ggacactcaccttggt

SEQ ID NO: 1105 - DNA, 16 bp, Artificial sequence
  Synthetic oligonucleotide
ttaaagaccttacctg

SEQ ID NO: 1106 - DNA, 16 bp, Artificial sequence
  Synthetic oligonucleotide
gaggcatcaagagcta

SEQ ID NO: 1107 - DNA, 16 bp, Artificial sequence
  Synthetic oligonucleotide
ggaggaaaggagatcg

SEQ ID NO: 1108 - DNA, 16 bp, Artificial sequence
  Synthetic oligonucleotide
ctagggtgaacagaac

SEQ ID NO: 1109 - DNA, 16 bp, Artificial sequence
  Synthetic oligonucleotide
cccgccccaagggtct

SEQ ID NO: 1110 - DNA, 16 bp, Artificial sequence
  Synthetic oligonucleotide
gctaagcctgcagaat

SEQ ID NO: 1111 - DNA, 16 bp, Artificial sequence
  Synthetic oligonucleotide
acgagaaacaaccgga

SEQ ID NO: 1112 - DNA, 16 bp, Artificial sequence
  Synthetic oligonucleotide
tagggttagcttaagt

SEQ ID NO: 1113 - DNA, 16 bp, Artificial sequence
  Synthetic oligonucleotide
agatgaacaccctatt

SEQ ID NO: 1114 - DNA, 16 bp, Artificial sequence
  Synthetic oligonucleotide
actaacctatttgact

SEQ ID NO: 1115 - DNA, 16 bp, Artificial sequence
  Synthetic oligonucleotide
tccagtacccacactc

SEQ ID NO: 1116 - DNA, 16 bp, Artificial sequence
  Synthetic oligonucleotide
cacctaatgctgatct

SEQ ID NO: 1117 - DNA, 16 bp, Artificial sequence
  Synthetic oligonucleotide
taattagggagaagat

SEQ ID NO: 1118 - DNA, 16 bp, Artificial sequence
  Synthetic oligonucleotide
ctgggtattgaattgt

SEQ ID NO: 1119 - DNA, 16 bp, Artificial sequence
  Synthetic oligonucleotide
cacaaagagcgagcaa

SEQ ID NO: 1120 - DNA, 16 bp, Artificial sequence
  Synthetic oligonucleotide
tctggttaagtcatta

SEQ ID NO: 1121 - DNA, 16 bp, Artificial sequence
  Synthetic oligonucleotide
cacctagagtcctgag

SEQ ID NO: 1122 - DNA, 16 bp, Artificial sequence
  Synthetic oligonucleotide
catcatcagactctct

SEQ ID NO: 1123 - DNA, 16 bp, Artificial sequence
  Synthetic oligonucleotide
ttcatagggcctcttg

SEQ ID NO: 1124 - DNA, 16 bp, Artificial sequence
  Synthetic oligonucleotide
atactgggacccctgg

SEQ ID NO: 1125 - DNA, 16 bp, Artificial sequence
  Synthetic oligonucleotide
ttccgagaactggctg

SEQ ID NO: 1126 - DNA, 16 bp, Artificial sequence
  Synthetic oligonucleotide
cagatttttccgccat

SEQ ID NO: 1127 - DNA, 16 bp, Artificial sequence
  Synthetic oligonucleotide
gtagaggacctagagg

SEQ ID NO: 1128 - DNA, 16 bp, Artificial sequence
  Synthetic oligonucleotide
ggtcacttctgaagct

SEQ ID NO: 1129 - DNA, 16 bp, Artificial sequence
  Synthetic oligonucleotide
ggcttagaacattact

SEQ ID NO: 1130 - DNA, 16 bp, Artificial sequence
  Synthetic oligonucleotide
ttaggaagtgtttccg

SEQ ID NO: 1131 - DNA, 16 bp, Artificial sequence
  Synthetic oligonucleotide
atcctataatcctggt

SEQ ID NO: 1132 - DNA, 16 bp, Artificial sequence
  Synthetic oligonucleotide
cctgtagaagcttctc

SEQ ID NO: 1133 - DNA, 16 bp, Artificial sequence
  Synthetic oligonucleotide
gaagagtctggcatta

SEQ ID NO: 1134 - DNA, 16 bp, Artificial sequence
  Synthetic oligonucleotide
ttttagcttgagcagc

SEQ ID NO: 1135 - DNA, 16 bp, Artificial sequence
  Synthetic oligonucleotide
attgtaacagtcctgg

SEQ ID NO: 1136 - DNA, 16 bp, Artificial sequence
  Synthetic oligonucleotide
ctccacttgagagctg

SEQ ID NO: 1137 - DNA, 16 bp, Artificial sequence
  Synthetic oligonucleotide
ggctgggacatgtccc

SEQ ID NO: 1138 - DNA, 16 bp, Artificial sequence
  Synthetic oligonucleotide
cagtaaaggtcggcac

SEQ ID NO: 1139 - DNA, 16 bp, Artificial sequence
  Synthetic oligonucleotide
tcgagtaactttttaa

SEQ ID NO: 1140 - DNA, 16 bp, Artificial sequence
  Synthetic oligonucleotide
ggtgagaggccatcct

SEQ ID NO: 1141 - DNA, 16 bp, Artificial sequence
  Synthetic oligonucleotide
tcagaatagcctacac

SEQ ID NO: 1142 - DNA, 16 bp, Artificial sequence
  Synthetic oligonucleotide
acattttgactagctt

SEQ ID NO: 1143 - DNA, 16 bp, Artificial sequence
  Synthetic oligonucleotide
agcctcgaaaaccctg

SEQ ID NO: 1144 - DNA, 16 bp, Artificial sequence
  Synthetic oligonucleotide
gaacccacagtctcag

SEQ ID NO: 1145 - DNA, 16 bp, Artificial sequence
  Synthetic oligonucleotide
aataaggctggcatgt

SEQ ID NO: 1146 - DNA, 16 bp, Artificial sequence
  Synthetic oligonucleotide
gtggagggacggcctg

SEQ ID NO: 1147 - DNA, 16 bp, Artificial sequence
  Synthetic oligonucleotide
tatccctatcccttac

SEQ ID NO: 1148 - DNA, 16 bp, Artificial sequence
  Synthetic oligonucleotide
ggcacaaacatgaggc

SEQ ID NO: 1149 - DNA, 16 bp, Artificial sequence
  Synthetic oligonucleotide
acaactcaggatcaca

SEQ ID NO: 1150 - DNA, 16 bp, Artificial sequence
  Synthetic oligonucleotide
cacctaaacccccctg

SEQ ID NO: 1151 - DNA, 16 bp, Artificial sequence
  Synthetic oligonucleotide
gtcggatgatgcctgg

SEQ ID NO: 1152 - DNA, 16 bp, Artificial sequence
  Synthetic oligonucleotide
ttgtgagcggatgcat

SEQ ID NO: 1153 - DNA, 16 bp, Artificial sequence
  Synthetic oligonucleotide
aatatagtagctggag

SEQ ID NO: 1154 - DNA, 16 bp, Artificial sequence
  Synthetic oligonucleotide
ccaccccgattttcct

SEQ ID NO: 1155 - DNA, 16 bp, Artificial sequence
  Synthetic oligonucleotide
ggatgacagtcaaggt

SEQ ID NO: 1156 - DNA, 16 bp, Artificial sequence
  Synthetic oligonucleotide
tgccaaaatagttctc

SEQ ID NO: 1157 - DNA, 16 bp, Artificial sequence
  Synthetic oligonucleotide
ctacaggcctgagatc

SEQ ID NO: 1158 - DNA, 16 bp, Artificial sequence
  Synthetic oligonucleotide
ggatgaatcaagcccc

SEQ ID NO: 1159 - DNA, 16 bp, Artificial sequence
  Synthetic oligonucleotide
ttggcatgctctggcc

SEQ ID NO: 1160 - DNA, 16 bp, Artificial sequence
  Synthetic oligonucleotide
gttagagtaagagctg

SEQ ID NO: 1161 - DNA, 16 bp, Artificial sequence
  Synthetic oligonucleotide
ttctgagaaggcattg

SEQ ID NO: 1162 - DNA, 16 bp, Artificial sequence
  Synthetic oligonucleotide
cagggaatttgatcag

SEQ ID NO: 1163 - DNA, 16 bp, Artificial sequence
  Synthetic oligonucleotide
gatgacttggctttag

SEQ ID NO: 1164 - DNA, 16 bp, Artificial sequence
  Synthetic oligonucleotide
gtatggttgttctggg

SEQ ID NO: 1165 - DNA, 16 bp, Artificial sequence
  Synthetic oligonucleotide
gaagccgcagacctct

SEQ ID NO: 1166 - DNA, 16 bp, Artificial sequence
  Synthetic oligonucleotide
gcaggcttggtgaagt

SEQ ID NO: 1167 - DNA, 16 bp, Artificial sequence
  Synthetic oligonucleotide
aagatctcggccctgg

SEQ ID NO: 1168 - DNA, 16 bp, Artificial sequence
  Synthetic oligonucleotide
tgcatgaaatgtggcc

SEQ ID NO: 1169 - DNA, 16 bp, Artificial sequence
  Synthetic oligonucleotide
cctggacacccattcc

SEQ ID NO: 1170 - DNA, 16 bp, Artificial sequence
  Synthetic oligonucleotide
tcttcgaagaccttct

SEQ ID NO: 1171 - DNA, 16 bp, Artificial sequence
  Synthetic oligonucleotide
aagccttggtcagtgc

SEQ ID NO: 1172 - DNA, 16 bp, Artificial sequence
  Synthetic oligonucleotide
ccacaggtgcctccgg

SEQ ID NO: 1173 - DNA, 16 bp, Artificial sequence
  Synthetic oligonucleotide
atctcattgagtgtcc

SEQ ID NO: 1174 - DNA, 16 bp, Artificial sequence
  Synthetic oligonucleotide
aggtgtagggttggaa

SEQ ID NO: 1175 - DNA, 16 bp, Artificial sequence
  Synthetic oligonucleotide
tgtttggctgcagggc

SEQ ID NO: 1176 - DNA, 16 bp, Artificial sequence
  Synthetic oligonucleotide
ttgagtgtactgaggc

SEQ ID NO: 1177 - DNA, 16 bp, Artificial sequence
  Synthetic oligonucleotide
agatcctgagggtact

SEQ ID NO: 1178 - DNA, 16 bp, Artificial sequence
  Synthetic oligonucleotide
tgaggcatggatcagg

SEQ ID NO: 1179 - DNA, 16 bp, Artificial sequence
  Synthetic oligonucleotide
gagggcgaggatcctt

SEQ ID NO: 1180 - DNA, 16 bp, Artificial sequence
  Synthetic oligonucleotide
gcctatgagcccagac

SEQ ID NO: 1181 - DNA, 16 bp, Artificial sequence
  Synthetic oligonucleotide
gagcagggacactcac

SEQ ID NO: 1182 - DNA, 16 bp, Artificial sequence
  Synthetic oligonucleotide
taagtcttctgccatt

SEQ ID NO: 1183 - DNA, 16 bp, Artificial sequence
  Synthetic oligonucleotide
gatgagaggcatcaag

SEQ ID NO: 1184 - DNA, 16 bp, Artificial sequence
  Synthetic oligonucleotide
caagaaaagagagcgg

SEQ ID NO: 1185 - DNA, 16 bp, Artificial sequence
  Synthetic oligonucleotide
tactagggtgaacaga

SEQ ID NO: 1186 - DNA, 16 bp, Artificial sequence
  Synthetic oligonucleotide
tacggttgacaatggt

SEQ ID NO: 1187 - DNA, 16 bp, Artificial sequence
  Synthetic oligonucleotide
cgtgagcacttacttt

SEQ ID NO: 1188 - DNA, 16 bp, Artificial sequence
  Synthetic oligonucleotide
aacgagaaacaaccgg

SEQ ID NO: 1189 - DNA, 16 bp, Artificial sequence
  Synthetic oligonucleotide
ctagggttagcttaag

SEQ ID NO: 1190 - DNA, 16 bp, Artificial sequence
  Synthetic oligonucleotide
aagatgaacaccctat

SEQ ID NO: 1191 - DNA, 16 bp, Artificial sequence
  Synthetic oligonucleotide
gactaacctatttgac

SEQ ID NO: 1192 - DNA, 16 bp, Artificial sequence
  Synthetic oligonucleotide
agtctggctccagtac

SEQ ID NO: 1193 - DNA, 16 bp, Artificial sequence
  Synthetic oligonucleotide
acacctaatgctgatc

SEQ ID NO: 1194 - DNA, 16 bp, Artificial sequence
  Synthetic oligonucleotide
gataattagggagaag

SEQ ID NO: 1195 - DNA, 16 bp, Artificial sequence
  Synthetic oligonucleotide
gctgggtattgaattg

SEQ ID NO: 1196 - DNA, 16 bp, Artificial sequence
  Synthetic oligonucleotide
acacaaagagcgagca

SEQ ID NO: 1197 - DNA, 16 bp, Artificial sequence
  Synthetic oligonucleotide
gtctggttaagtcatt

SEQ ID NO: 1198 - DNA, 16 bp, Artificial sequence
  Synthetic oligonucleotide
tcccacctagagtcct

SEQ ID NO: 1199 - DNA, 16 bp, Artificial sequence
  Synthetic oligonucleotide
gcccatcatcagactc

SEQ ID NO: 1200 - DNA, 16 bp, Artificial sequence
  Synthetic oligonucleotide
cttcatagggcctctt

SEQ ID NO: 1201 - DNA, 16 bp, Artificial sequence
  Synthetic oligonucleotide
gatactgggacccctg

SEQ ID NO: 1202 - DNA, 16 bp, Artificial sequence
  Synthetic oligonucleotide
caccccacaggtttcg

SEQ ID NO: 1203 - DNA, 16 bp, Artificial sequence
  Synthetic oligonucleotide
cccagatttttccgcc

SEQ ID NO: 1204 - DNA, 16 bp, Artificial sequence
  Synthetic oligonucleotide
gagatgatctgtctgg

SEQ ID NO: 1205 - DNA, 16 bp, Artificial sequence
  Synthetic oligonucleotide
atttcggtgcaaatgg

SEQ ID NO: 1206 - DNA, 16 bp, Artificial sequence
  Synthetic oligonucleotide
gggcttagaacattac

SEQ ID NO: 1207 - DNA, 16 bp, Artificial sequence
  Synthetic oligonucleotide
gaactccacttctttc

SEQ ID NO: 1208 - DNA, 16 bp, Artificial sequence
  Synthetic oligonucleotide
tccgggccccctgctg

SEQ ID NO: 1209 - DNA, 16 bp, Artificial sequence
  Synthetic oligonucleotide
gcctgtagaagcttct

SEQ ID NO: 1210 - DNA, 16 bp, Artificial sequence
  Synthetic oligonucleotide
tgaagagtctggcatt

SEQ ID NO: 1211 - DNA, 16 bp, Artificial sequence
  Synthetic oligonucleotide
gttttagcttgagcag

SEQ ID NO: 1212 - DNA, 16 bp, Artificial sequence
  Synthetic oligonucleotide
tattgtaacagtcctg

SEQ ID NO: 1213 - DNA, 16 bp, Artificial sequence
  Synthetic oligonucleotide
ccctccacttgagagc

SEQ ID NO: 1214 - DNA, 16 bp, Artificial sequence
  Synthetic oligonucleotide
ttggctgggacatgtc

SEQ ID NO: 1215 - DNA, 16 bp, Artificial sequence
  Synthetic oligonucleotide
cacagtaaaggtcggc

SEQ ID NO: 1216 - DNA, 16 bp, Artificial sequence
  Synthetic oligonucleotide
atcgagtaacttttta

SEQ ID NO: 1217 - DNA, 16 bp, Artificial sequence
  Synthetic oligonucleotide
gggtgagaggccatcc

SEQ ID NO: 1218 - DNA, 16 bp, Artificial sequence
  Synthetic oligonucleotide
attcagaatagcctac

SEQ ID NO: 1219 - DNA, 16 bp, Artificial sequence
  Synthetic oligonucleotide
gacattttgactagct

SEQ ID NO: 1220 - DNA, 16 bp, Artificial sequence
  Synthetic oligonucleotide
cctgagcctcgaaaac

SEQ ID NO: 1221 - DNA, 16 bp, Artificial sequence
  Synthetic oligonucleotide
ttgaacccacagtctc

SEQ ID NO: 1222 - DNA, 16 bp, Artificial sequence
  Synthetic oligonucleotide
gaataaggctggcatg

SEQ ID NO: 1223 - DNA, 16 bp, Artificial sequence
  Synthetic oligonucleotide
ttggaagtgtggtgag

SEQ ID NO: 1224 - DNA, 16 bp, Artificial sequence
  Synthetic oligonucleotide
ctatccctatccctta

SEQ ID NO: 1225 - DNA, 16 bp, Artificial sequence
  Synthetic oligonucleotide
tggcacaaacatgagg

SEQ ID NO: 1226 - DNA, 16 bp, Artificial sequence
  Synthetic oligonucleotide
taacaactcaggatca

SEQ ID NO: 1227 - DNA, 16 bp, Artificial sequence
  Synthetic oligonucleotide
tcacctaaacccccct

SEQ ID NO: 1228 - DNA, 16 bp, Artificial sequence
  Synthetic oligonucleotide
ttgtcggatgatgcct

SEQ ID NO: 1229 - DNA, 16 bp, Artificial sequence
  Synthetic oligonucleotide
cttttgtgagcggatg

SEQ ID NO: 1230 - DNA, 16 bp, Artificial sequence
  Synthetic oligonucleotide
gaatatagtagctgga

SEQ ID NO: 1231 - DNA, 16 bp, Artificial sequence
  Synthetic oligonucleotide
tccaccccgattttcc

SEQ ID NO: 1232 - DNA, 16 bp, Artificial sequence
  Synthetic oligonucleotide
ccaggatgacagtcaa

SEQ ID NO: 1233 - DNA, 16 bp, Artificial sequence
  Synthetic oligonucleotide
atttattctttgcacc

SEQ ID NO: 1234 - DNA, 16 bp, Artificial sequence
  Synthetic oligonucleotide
tctacaggcctgagat

SEQ ID NO: 1235 - DNA, 16 bp, Artificial sequence
  Synthetic oligonucleotide
aggaactctgtcagag

SEQ ID NO: 1236 - DNA, 16 bp, Artificial sequence
  Synthetic oligonucleotide
aatttggcatgctctg

SEQ ID NO: 1237 - DNA, 16 bp, Artificial sequence
  Synthetic oligonucleotide
agttagagtaagagct

SEQ ID NO: 1238 - DNA, 16 bp, Artificial sequence
  Synthetic oligonucleotide
gatgaaggttctgaga

SEQ ID NO: 1239 - DNA, 16 bp, Artificial sequence
  Synthetic oligonucleotide
gtcagggaatttgatc

SEQ ID NO: 1240 - DNA, 16 bp, Artificial sequence
  Synthetic oligonucleotide
atgggatgacttggct

SEQ ID NO: 1241 - DNA, 16 bp, Artificial sequence
  Synthetic oligonucleotide
tgggtatggttgttct

SEQ ID NO: 1242 - DNA, 16 bp, Artificial sequence
  Synthetic oligonucleotide
tgtggaagccgcagac

SEQ ID NO: 1243 - DNA, 16 bp, Artificial sequence
  Synthetic oligonucleotide
caagggcaggcttggt

SEQ ID NO: 1244 - DNA, 16 bp, Artificial sequence
  Synthetic oligonucleotide
cgaagatctcggccct

SEQ ID NO: 1245 - DNA, 16 bp, Artificial sequence
  Synthetic oligonucleotide
ggtgcatgaaatgtgg

SEQ ID NO: 1246 - DNA, 16 bp, Artificial sequence
  Synthetic oligonucleotide
ccctggacacccattc

SEQ ID NO: 1247 - DNA, 16 bp, Artificial sequence
  Synthetic oligonucleotide
ctcttcgaagaccttc

SEQ ID NO: 1248 - DNA, 16 bp, Artificial sequence
  Synthetic oligonucleotide
gaagccttggtcagtg

SEQ ID NO: 1249 - DNA, 16 bp, Artificial sequence
  Synthetic oligonucleotide
taccccacaggtgcct

SEQ ID NO: 1250 - DNA, 16 bp, Artificial sequence
  Synthetic oligonucleotide
gtggtagatctcattg

SEQ ID NO: 1251 - DNA, 16 bp, Artificial sequence
  Synthetic oligonucleotide
caggtgtagggttgga

SEQ ID NO: 1252 - DNA, 16 bp, Artificial sequence
  Synthetic oligonucleotide
gtgaaggctctgtttg

SEQ ID NO: 1253 - DNA, 16 bp, Artificial sequence
  Synthetic oligonucleotide
gtttgagtgtactgag

SEQ ID NO: 1254 - DNA, 16 bp, Artificial sequence
  Synthetic oligonucleotide
tcagatcctgagggta

SEQ ID NO: 1255 - DNA, 16 bp, Artificial sequence
  Synthetic oligonucleotide
ctgaggcatggatcag

SEQ ID NO: 1256 - DNA, 16 bp, Artificial sequence
  Synthetic oligonucleotide
ggagggcgaggatcct

SEQ ID NO: 1257 - DNA, 16 bp, Artificial sequence
  Synthetic oligonucleotide
aatgtgcctatgagcc

SEQ ID NO: 1258 - DNA, 16 bp, Artificial sequence
  Synthetic oligonucleotide
cccgccgtgcctacct

SEQ ID NO: 1259 - DNA, 16 bp, Artificial sequence
  Synthetic oligonucleotide
gtacttcacctttaag

SEQ ID NO: 1260 - DNA, 16 bp, Artificial sequence
  Synthetic oligonucleotide
ggatgagaggcatcaa

SEQ ID NO: 1261 - DNA, 16 bp, Artificial sequence
  Synthetic oligonucleotide
gcaagaaaagagagcg

SEQ ID NO: 1262 - DNA, 16 bp, Artificial sequence
  Synthetic oligonucleotide
ctactagggtgaacag

SEQ ID NO: 1263 - DNA, 16 bp, Artificial sequence
  Synthetic oligonucleotide
ctacggttgacaatgg

SEQ ID NO: 1264 - DNA, 16 bp, Artificial sequence
  Synthetic oligonucleotide
tctaatttggttacag

SEQ ID NO: 1265 - DNA, 16 bp, Artificial sequence
  Synthetic oligonucleotide
aaacgagaaacaaccg

SEQ ID NO: 1266 - DNA, 16 bp, Artificial sequence
  Synthetic oligonucleotide
acctagggttagctta

SEQ ID NO: 1267 - DNA, 16 bp, Artificial sequence
  Synthetic oligonucleotide
taagatgaacacccta

SEQ ID NO: 1268 - DNA, 16 bp, Artificial sequence
  Synthetic oligonucleotide
agactaacctatttga

SEQ ID NO: 1269 - DNA, 16 bp, Artificial sequence
  Synthetic oligonucleotide
ctgggtttgtcccaga

SEQ ID NO: 1270 - DNA, 16 bp, Artificial sequence
  Synthetic oligonucleotide
taacacctaatgctga

SEQ ID NO: 1271 - DNA, 16 bp, Artificial sequence
  Synthetic oligonucleotide
ctgagataattaggga

SEQ ID NO: 1272 - DNA, 16 bp, Artificial sequence
  Synthetic oligonucleotide
ggctgggtattgaatt

SEQ ID NO: 1273 - DNA, 16 bp, Artificial sequence
  Synthetic oligonucleotide
cacacaaagagcgagc

SEQ ID NO: 1274 - DNA, 16 bp, Artificial sequence
  Synthetic oligonucleotide
cttctacgctgtctgg

SEQ ID NO: 1275 - DNA, 16 bp, Artificial sequence
  Synthetic oligonucleotide
ggagagagccagaacc

SEQ ID NO: 1276 - DNA, 16 bp, Artificial sequence
  Synthetic oligonucleotide
tacagagcccatcatc

SEQ ID NO: 1277 - DNA, 16 bp, Artificial sequence
  Synthetic oligonucleotide
agtcaggcagcttgct

SEQ ID NO: 1278 - DNA, 16 bp, Artificial sequence
  Synthetic oligonucleotide
agatactgggacccct

SEQ ID NO: 1279 - DNA, 16 bp, Artificial sequence
  Synthetic oligonucleotide
gataccccaccccaca

SEQ ID NO: 1280 - DNA, 16 bp, Artificial sequence
  Synthetic oligonucleotide
gcccagatttttccgc

SEQ ID NO: 1281 - DNA, 16 bp, Artificial sequence
  Synthetic oligonucleotide
ggagatgatctgtctg

SEQ ID NO: 1282 - DNA, 16 bp, Artificial sequence
  Synthetic oligonucleotide
gatttcggtgcaaatg

SEQ ID NO: 1283 - DNA, 16 bp, Artificial sequence
  Synthetic oligonucleotide
gttcttagtctcctgg

SEQ ID NO: 1284 - DNA, 16 bp, Artificial sequence
  Synthetic oligonucleotide
gagaactccacttctt

SEQ ID NO: 1285 - DNA, 16 bp, Artificial sequence
  Synthetic oligonucleotide
ccacaatggctccggg

SEQ ID NO: 1286 - DNA, 16 bp, Artificial sequence
  Synthetic oligonucleotide
agcatggcaagtgaca

SEQ ID NO: 1287 - DNA, 16 bp, Artificial sequence
  Synthetic oligonucleotide
atgaagagtctggcat

SEQ ID NO: 1288 - DNA, 16 bp, Artificial sequence
  Synthetic oligonucleotide
ggttttagcttgagca

SEQ ID NO: 1289 - DNA, 16 bp, Artificial sequence
  Synthetic oligonucleotide
ctattgtaacagtcct

SEQ ID NO: 1290 - DNA, 16 bp, Artificial sequence
  Synthetic oligonucleotide
caatggttgtttcccc

SEQ ID NO: 1291 - DNA, 16 bp, Artificial sequence
  Synthetic oligonucleotide
gcattggctgggacat

SEQ ID NO: 1292 - DNA, 16 bp, Artificial sequence
  Synthetic oligonucleotide
ccacagtaaaggtcgg

SEQ ID NO: 1293 - DNA, 16 bp, Artificial sequence
  Synthetic oligonucleotide
gatcgagtaacttttt

SEQ ID NO: 1294 - DNA, 16 bp, Artificial sequence
  Synthetic oligonucleotide
acctggtgcatgaaat

SEQ ID NO: 1295 - DNA, 16 bp, Artificial sequence
  Synthetic oligonucleotide
caattcagaatagcct

SEQ ID NO: 1296 - DNA, 16 bp, Artificial sequence
  Synthetic oligonucleotide
tgacattttgactagc

SEQ ID NO: 1297 - DNA, 16 bp, Artificial sequence
  Synthetic oligonucleotide
attttgagcttcccac

SEQ ID NO: 1298 - DNA, 16 bp, Artificial sequence
  Synthetic oligonucleotide
tttgaacccacagtct

SEQ ID NO: 1299 - DNA, 16 bp, Artificial sequence
  Synthetic oligonucleotide
ggaataaggctggcat

SEQ ID NO: 1300 - DNA, 16 bp, Artificial sequence
  Synthetic oligonucleotide
gagataatgttggaag

SEQ ID NO: 1301 - DNA, 16 bp, Artificial sequence
  Synthetic oligonucleotide
actatccctatccctt

SEQ ID NO: 1302 - DNA, 16 bp, Artificial sequence
  Synthetic oligonucleotide
caccacagatgaagcc

SEQ ID NO: 1303 - DNA, 16 bp, Artificial sequence
  Synthetic oligonucleotide
ttaacaactcaggatc

SEQ ID NO: 1304 - DNA, 16 bp, Artificial sequence
  Synthetic oligonucleotide
agtcacctaaaccccc

SEQ ID NO: 1305 - DNA, 16 bp, Artificial sequence
  Synthetic oligonucleotide
ttacctgggaatgtgc

SEQ ID NO: 1306 - DNA, 16 bp, Artificial sequence
  Synthetic oligonucleotide
gcttttgtgagcggat

SEQ ID NO: 1307 - DNA, 16 bp, Artificial sequence
  Synthetic oligonucleotide
cgaatatagtagctgg

SEQ ID NO: 1308 - DNA, 16 bp, Artificial sequence
  Synthetic oligonucleotide
atccaccccgattttc

SEQ ID NO: 1309 - DNA, 16 bp, Artificial sequence
  Synthetic oligonucleotide
tgcaagaggttaaatg

SEQ ID NO: 1310 - DNA, 16 bp, Artificial sequence
  Synthetic oligonucleotide
cataagttgtatcatt

SEQ ID NO: 1311 - DNA, 16 bp, Artificial sequence
  Synthetic oligonucleotide
gtctacaggcctgaga

SEQ ID NO: 1312 - DNA, 16 bp, Artificial sequence
  Synthetic oligonucleotide
gaggaactctgtcaga

SEQ ID NO: 1313 - DNA, 16 bp, Artificial sequence
  Synthetic oligonucleotide
gaatttggcatgctct

SEQ ID NO: 1314 - DNA, 16 bp, Artificial sequence
  Synthetic oligonucleotide
gagttagagtaagagc

SEQ ID NO: 1315 - DNA, 16 bp, Artificial sequence
  Synthetic oligonucleotide
ggatgaaggttctgag

SEQ ID NO: 1316 - DNA, 16 bp, Artificial sequence
  Synthetic oligonucleotide
ggtcagggaatttgat

SEQ ID NO: 1317 - DNA, 16 bp, Artificial sequence
  Synthetic oligonucleotide
ttaagagtcaggctgg

SEQ ID NO: 1318 - DNA, 16 bp, Artificial sequence
  Synthetic oligonucleotide
gtgggtatggttgttc

SEQ ID NO: 1319 - DNA, 16 bp, Artificial sequence
  Synthetic oligonucleotide
ggtgtggaagccgcag

SEQ ID NO: 1320 - DNA, 16 bp, Artificial sequence
  Synthetic oligonucleotide
gggtccttgtccaagg

SEQ ID NO: 1321 - DNA, 16 bp, Artificial sequence
  Synthetic oligonucleotide
cctcgaagatctcggc

SEQ ID NO: 1322 - DNA, 16 bp, Artificial sequence
  Synthetic oligonucleotide
tggtgcatgaaatgtg

SEQ ID NO: 1323 - DNA, 16 bp, Artificial sequence
  Synthetic oligonucleotide
tccctggacacccatt

SEQ ID NO: 1324 - DNA, 16 bp, Artificial sequence
  Synthetic oligonucleotide
gctcttcgaagacctt

SEQ ID NO: 1325 - DNA, 16 bp, Artificial sequence
  Synthetic oligonucleotide
atgaagccttggtcag

SEQ ID NO: 1326 - DNA, 16 bp, Artificial sequence
  Synthetic oligonucleotide
ctaccccacaggtgcc

SEQ ID NO: 1327 - DNA, 16 bp, Artificial sequence
  Synthetic oligonucleotide
agaaggcaaacatgcg

SEQ ID NO: 1328 - DNA, 16 bp, Artificial sequence
  Synthetic oligonucleotide
gccaggtgtagggttg

SEQ ID NO: 1329 - DNA, 16 bp, Artificial sequence
  Synthetic oligonucleotide
tgtgaaggctctgttt

SEQ ID NO: 1330 - DNA, 16 bp, Artificial sequence
  Synthetic oligonucleotide
tgtttgagtgtactga

SEQ ID NO: 1331 - DNA, 16 bp, Artificial sequence
  Synthetic oligonucleotide
ctcagatcctgagggt

SEQ ID NO: 1332 - DNA, 16 bp, Artificial sequence
  Synthetic oligonucleotide
gctgaggcatggatca

SEQ ID NO: 1333 - DNA, 16 bp, Artificial sequence
  Synthetic oligonucleotide
aggagggcgaggatcc

SEQ ID NO: 1334 - DNA, 16 bp, Artificial sequence
  Synthetic oligonucleotide
cccaatgtgcctatga

SEQ ID NO: 1335 - DNA, 16 bp, Artificial sequence
  Synthetic oligonucleotide
ccagagggcccctgac

SEQ ID NO: 1336 - DNA, 16 bp, Artificial sequence
  Synthetic oligonucleotide
agtacttcacctttaa

SEQ ID NO: 1337 - DNA, 16 bp, Artificial sequence
  Synthetic oligonucleotide
aaggatgagaggcatc

SEQ ID NO: 1338 - DNA, 16 bp, Artificial sequence
  Synthetic oligonucleotide
taggctggatgctggc

SEQ ID NO: 1339 - DNA, 16 bp, Artificial sequence
  Synthetic oligonucleotide
tgctactagggtgaac

SEQ ID NO: 1340 - DNA, 16 bp, Artificial sequence
  Synthetic oligonucleotide
actacggttgacaatg

SEQ ID NO: 1341 - DNA, 16 bp, Artificial sequence
  Synthetic oligonucleotide
catgattctaatttgg

SEQ ID NO: 1342 - DNA, 16 bp, Artificial sequence
  Synthetic oligonucleotide
agtcagggatgtttat

SEQ ID NO: 1343 - DNA, 16 bp, Artificial sequence
  Synthetic oligonucleotide
cacctagggttagctt

SEQ ID NO: 1344 - DNA, 16 bp, Artificial sequence
  Synthetic oligonucleotide
ataagatgaacaccct

SEQ ID NO: 1345 - DNA, 16 bp, Artificial sequence
  Synthetic oligonucleotide
aagactaacctatttg

SEQ ID NO: 1346 - DNA, 16 bp, Artificial sequence
  Synthetic oligonucleotide
gctgggtttgtcccag

SEQ ID NO: 1347 - DNA, 16 bp, Artificial sequence
  Synthetic oligonucleotide
tttaacacctaatgct

SEQ ID NO: 1348 - DNA, 16 bp, Artificial sequence
  Synthetic oligonucleotide
tctgagataattaggg

SEQ ID NO: 1349 - DNA, 16 bp, Artificial sequence
  Synthetic oligonucleotide
atggctgggtattgaa

SEQ ID NO: 1350 - DNA, 16 bp, Artificial sequence
  Synthetic oligonucleotide
ggatacatagagacaa

SEQ ID NO: 1351 - DNA, 16 bp, Artificial sequence
  Synthetic oligonucleotide
gccagggcccttctac

SEQ ID NO: 1352 - DNA, 16 bp, Artificial sequence
  Synthetic oligonucleotide
aatacagagcccatca

SEQ ID NO: 1353 - DNA, 16 bp, Artificial sequence
  Synthetic oligonucleotide
gaaagtcaggcagctt

SEQ ID NO: 1354 - DNA, 16 bp, Artificial sequence
  Synthetic oligonucleotide
cacagatactgggacc

SEQ ID NO: 1355 - DNA, 16 bp, Artificial sequence
  Synthetic oligonucleotide
gcagataccccacccc

SEQ ID NO: 1356 - DNA, 16 bp, Artificial sequence
  Synthetic oligonucleotide
gacttgcccagatttt

SEQ ID NO: 1357 - DNA, 16 bp, Artificial sequence
  Synthetic oligonucleotide
tggagatgatctgtct

SEQ ID NO: 1358 - DNA, 16 bp, Artificial sequence
  Synthetic oligonucleotide
cgatttcggtgcaaat

SEQ ID NO: 1359 - DNA, 16 bp, Artificial sequence
  Synthetic oligonucleotide
agttcttagtctcctg

SEQ ID NO: 1360 - DNA, 16 bp, Artificial sequence
  Synthetic oligonucleotide
ttgagaactccacttc

SEQ ID NO: 1361 - DNA, 16 bp, Artificial sequence
  Synthetic oligonucleotide
ccctccacaatggctc

SEQ ID NO: 1362 - DNA, 16 bp, Artificial sequence
  Synthetic oligonucleotide
ccagcatggcaagtga

SEQ ID NO: 1363 - DNA, 16 bp, Artificial sequence
  Synthetic oligonucleotide
catgaagagtctggca

SEQ ID NO: 1364 - DNA, 16 bp, Artificial sequence
  Synthetic oligonucleotide
gggttttagcttgagc

SEQ ID NO: 1365 - DNA, 16 bp, Artificial sequence
  Synthetic oligonucleotide
ggctattgtaacagtc

SEQ ID NO: 1366 - DNA, 16 bp, Artificial sequence
  Synthetic oligonucleotide
gggcaatggttgtttc

SEQ ID NO: 1367 - DNA, 16 bp, Artificial sequence
  Synthetic oligonucleotide
ggcattggctgggaca

SEQ ID NO: 1368 - DNA, 16 bp, Artificial sequence
  Synthetic oligonucleotide
tgccacagtaaaggtc

SEQ ID NO: 1369 - DNA, 16 bp, Artificial sequence
  Synthetic oligonucleotide
agatcgagtaactttt

SEQ ID NO: 1370 - DNA, 16 bp, Artificial sequence
  Synthetic oligonucleotide
tacctggtgcatgaaa

SEQ ID NO: 1371 - DNA, 16 bp, Artificial sequence
  Synthetic oligonucleotide
gcaattcagaatagcc

SEQ ID NO: 1372 - DNA, 16 bp, Artificial sequence
  Synthetic oligonucleotide
ctgacattttgactag

SEQ ID NO: 1373 - DNA, 16 bp, Artificial sequence
  Synthetic oligonucleotide
acaaggcctctcattt

SEQ ID NO: 1374 - DNA, 16 bp, Artificial sequence
  Synthetic oligonucleotide
gccagtcagggatgga

SEQ ID NO: 1375 - DNA, 16 bp, Artificial sequence
  Synthetic oligonucleotide
tggaataaggctggca

SEQ ID NO: 1376 - DNA, 16 bp, Artificial sequence
  Synthetic oligonucleotide
cttgagcctggccaga

SEQ ID NO: 1377 - DNA, 16 bp, Artificial sequence
  Synthetic oligonucleotide
gcactatccctatccc

SEQ ID NO: 1378 - DNA, 16 bp, Artificial sequence
  Synthetic oligonucleotide
ctcaccacagatgaag

SEQ ID NO: 1379 - DNA, 16 bp, Artificial sequence
  Synthetic oligonucleotide
tttaacaactcaggat

SEQ ID NO: 1380 - DNA, 16 bp, Artificial sequence
  Synthetic oligonucleotide
gaaagtcacctaaacc

SEQ ID NO: 1381 - DNA, 16 bp, Artificial sequence
  Synthetic oligonucleotide
tcttacctgggaatgt

SEQ ID NO: 1382 - DNA, 16 bp, Artificial sequence
  Synthetic oligonucleotide
agcttttgtgagcgga

SEQ ID NO: 1383 - DNA, 16 bp, Artificial sequence
  Synthetic oligonucleotide
ccgaatatagtagctg

SEQ ID NO: 1384 - DNA, 16 bp, Artificial sequence
  Synthetic oligonucleotide
gaatccaccccgattt

SEQ ID NO: 1385 - DNA, 16 bp, Artificial sequence
  Synthetic oligonucleotide
gatgcaagaggttaaa

SEQ ID NO: 1386 - DNA, 16 bp, Artificial sequence
  Synthetic oligonucleotide
gacataagttgtatca

SEQ ID NO: 1387 - DNA, 16 bp, Artificial sequence
  Synthetic oligonucleotide
gagtctacaggcctga

SEQ ID NO: 1388 - DNA, 16 bp, Artificial sequence
  Synthetic oligonucleotide
ggaggaactctgtcag

SEQ ID NO: 1389 - DNA, 16 bp, Artificial sequence
  Synthetic oligonucleotide
agaatttggcatgctc

SEQ ID NO: 1390 - DNA, 16 bp, Artificial sequence
  Synthetic oligonucleotide
ggagttagagtaagag

SEQ ID NO: 1391 - DNA, 16 bp, Artificial sequence
  Synthetic oligonucleotide
aggatgaaggttctga

SEQ ID NO: 1392 - DNA, 16 bp, Artificial sequence
  Synthetic oligonucleotide
ttcggtgtggagtgag

SEQ ID NO: 1393 - DNA, 16 bp, Artificial sequence
  Synthetic oligonucleotide
ggttaagagtcaggct

SEQ ID NO: 1394 - DNA, 16 bp, Artificial sequence
  Synthetic oligonucleotide
tgtgggtatggttgtt

SEQ ID NO: 1395 - DNA, 16 bp, Artificial sequence
  Synthetic oligonucleotide
tacggtgtggaagccg

SEQ ID NO: 1396 - DNA, 16 bp, Artificial sequence
  Synthetic oligonucleotide
tcgggtccttgtccaa

SEQ ID NO: 1397 - DNA, 16 bp, Artificial sequence
  Synthetic oligonucleotide
gcctcgaagatctcgg

SEQ ID NO: 1398 - DNA, 16 bp, Artificial sequence
  Synthetic oligonucleotide
ctggtgcatgaaatgt

SEQ ID NO: 1399 - DNA, 16 bp, Artificial sequence
  Synthetic oligonucleotide
ccggctccctggacac

SEQ ID NO: 1400 - DNA, 16 bp, Artificial sequence
  Synthetic oligonucleotide
cctctggctcttcgaa

SEQ ID NO: 1401 - DNA, 16 bp, Artificial sequence
  Synthetic oligonucleotide
cagatgaagccttggt

SEQ ID NO: 1402 - DNA, 16 bp, Artificial sequence
  Synthetic oligonucleotide
gctaccccacaggtgc

SEQ ID NO: 1403 - DNA, 16 bp, Artificial sequence
  Synthetic oligonucleotide
gtggcaggatggtttc

SEQ ID NO: 1404 - DNA, 16 bp, Artificial sequence
  Synthetic oligonucleotide
cttgatcttgaggtca

SEQ ID NO: 1405 - DNA, 16 bp, Artificial sequence
  Synthetic oligonucleotide
ggctggttgtgaaggc

SEQ ID NO: 1406 - DNA, 16 bp, Artificial sequence
  Synthetic oligonucleotide
ttgtttgagtgtactg

SEQ ID NO: 1407 - DNA, 16 bp, Artificial sequence
  Synthetic oligonucleotide
gggacctcagatcctg

SEQ ID NO: 1408 - DNA, 16 bp, Artificial sequence
  Synthetic oligonucleotide
agtctaagctgaggca

SEQ ID NO: 1409 - DNA, 16 bp, Artificial sequence
  Synthetic oligonucleotide
taggagggcgaggatc

SEQ ID NO: 1410 - DNA, 16 bp, Artificial sequence
  Synthetic oligonucleotide
ccccaatgtgcctatg

SEQ ID NO: 1411 - DNA, 16 bp, Artificial sequence
  Synthetic oligonucleotide
accagagggcccctga

SEQ ID NO: 1412 - DNA, 16 bp, Artificial sequence
  Synthetic oligonucleotide
aagtacttcaccttta

SEQ ID NO: 1413 - DNA, 16 bp, Artificial sequence
  Synthetic oligonucleotide
cgggagaaagagaggc

SEQ ID NO: 1414 - DNA, 16 bp, Artificial sequence
  Synthetic oligonucleotide
ctctaggctggatgct

SEQ ID NO: 1415 - DNA, 16 bp, Artificial sequence
  Synthetic oligonucleotide
tgcaatcctcctgcta

SEQ ID NO: 1416 - DNA, 16 bp, Artificial sequence
  Synthetic oligonucleotide
aaactacggttgacaa

SEQ ID NO: 1417 - DNA, 16 bp, Artificial sequence
  Synthetic oligonucleotide
gcatgattctaatttg

SEQ ID NO: 1418 - DNA, 16 bp, Artificial sequence
  Synthetic oligonucleotide
tccaaggaagcagtca

SEQ ID NO: 1419 - DNA, 16 bp, Artificial sequence
  Synthetic oligonucleotide
actcacctagggttag

SEQ ID NO: 1420 - DNA, 16 bp, Artificial sequence
  Synthetic oligonucleotide
aataagatgaacaccc

SEQ ID NO: 1421 - DNA, 16 bp, Artificial sequence
  Synthetic oligonucleotide
ggactttctaagcaca

SEQ ID NO: 1422 - DNA, 16 bp, Artificial sequence
  Synthetic oligonucleotide
cgctgggtttgtccca

SEQ ID NO: 1423 - DNA, 16 bp, Artificial sequence
  Synthetic oligonucleotide
gttttaacacctaatg

SEQ ID NO: 1424 - DNA, 16 bp, Artificial sequence
  Synthetic oligonucleotide
ggagtatggtttaaca

SEQ ID NO: 1425 - DNA, 16 bp, Artificial sequence
  Synthetic oligonucleotide
cccatggctgggtatt

SEQ ID NO: 1426 - DNA, 16 bp, Artificial sequence
  Synthetic oligonucleotide
gggatacatagagaca

SEQ ID NO: 1427 - DNA, 16 bp, Artificial sequence
  Synthetic oligonucleotide
ggccagggcccttcta

SEQ ID NO: 1428 - DNA, 16 bp, Artificial sequence
  Synthetic oligonucleotide
gaatggtagcccaggt

SEQ ID NO: 1429 - DNA, 16 bp, Artificial sequence
  Synthetic oligonucleotide
caatacagagcccatc

SEQ ID NO: 1430 - DNA, 16 bp, Artificial sequence
  Synthetic oligonucleotide
tgaaagtcaggcagct

SEQ ID NO: 1431 - DNA, 16 bp, Artificial sequence
  Synthetic oligonucleotide
ccacagatactgggac

SEQ ID NO: 1432 - DNA, 16 bp, Artificial sequence
  Synthetic oligonucleotide
ggcagataccccaccc

SEQ ID NO: 1433 - DNA, 16 bp, Artificial sequence
  Synthetic oligonucleotide
cgacttgcccagattt

SEQ ID NO: 1434 - DNA, 16 bp, Artificial sequence
  Synthetic oligonucleotide
catagatacattctca

SEQ ID NO: 1435 - DNA, 16 bp, Artificial sequence
  Synthetic oligonucleotide
accgatttcggtgcaa

SEQ ID NO: 1436 - DNA, 16 bp, Artificial sequence
  Synthetic oligonucleotide
aagttcttagtctcct

SEQ ID NO: 1437 - DNA, 16 bp, Artificial sequence
  Synthetic oligonucleotide
cttgagaactccactt

SEQ ID NO: 1438 - DNA, 16 bp, Artificial sequence
  Synthetic oligonucleotide
aagccctccacaatgg

SEQ ID NO: 1439 - DNA, 16 bp, Artificial sequence
  Synthetic oligonucleotide
tccagcatggcaagtg

SEQ ID NO: 1440 - DNA, 16 bp, Artificial sequence
  Synthetic oligonucleotide
acatgaagagtctggc

SEQ ID NO: 1441 - DNA, 16 bp, Artificial sequence
  Synthetic oligonucleotide
atgggttttagcttga

SEQ ID NO: 1442 - DNA, 16 bp, Artificial sequence
  Synthetic oligonucleotide
aggctattgtaacagt

SEQ ID NO: 1443 - DNA, 16 bp, Artificial sequence
  Synthetic oligonucleotide
agggcaatggttgttt

SEQ ID NO: 1444 - DNA, 16 bp, Artificial sequence
  Synthetic oligonucleotide
ggtcaaagcaggcatt

SEQ ID NO: 1445 - DNA, 16 bp, Artificial sequence
  Synthetic oligonucleotide
cccgcccagtgccaca

SEQ ID NO: 1446 - DNA, 16 bp, Artificial sequence
  Synthetic oligonucleotide
gagatcgagtaacttt

SEQ ID NO: 1447 - DNA, 16 bp, Artificial sequence
  Synthetic oligonucleotide
atacctggtgcatgaa

SEQ ID NO: 1448 - DNA, 16 bp, Artificial sequence
  Synthetic oligonucleotide
tgcaattcagaatagc

SEQ ID NO: 1449 - DNA, 16 bp, Artificial sequence
  Synthetic oligonucleotide
gctgacattttgacta

SEQ ID NO: 1450 - DNA, 16 bp, Artificial sequence
  Synthetic oligonucleotide
cacaaggcctctcatt

SEQ ID NO: 1451 - DNA, 16 bp, Artificial sequence
  Synthetic oligonucleotide
cgagagaagctaagta

SEQ ID NO: 1452 - DNA, 16 bp, Artificial sequence
  Synthetic oligonucleotide
gtggaataaggctggc

SEQ ID NO: 1453 - DNA, 16 bp, Artificial sequence
  Synthetic oligonucleotide
ctcaccacttgagcct

SEQ ID NO: 1454 - DNA, 16 bp, Artificial sequence
  Synthetic oligonucleotide
gcgcactatccctatc

SEQ ID NO: 1455 - DNA, 16 bp, Artificial sequence
  Synthetic oligonucleotide
gctcaccacagatgaa

SEQ ID NO: 1456 - DNA, 16 bp, Artificial sequence
  Synthetic oligonucleotide
ctttaacaactcagga

SEQ ID NO: 1457 - DNA, 16 bp, Artificial sequence
  Synthetic oligonucleotide
ctctttaccacccaac

SEQ ID NO: 1458 - DNA, 16 bp, Artificial sequence
  Synthetic oligonucleotide
attcttacctgggaat

SEQ ID NO: 1459 - DNA, 16 bp, Artificial sequence
  Synthetic oligonucleotide
aagcttttgtgagcgg

SEQ ID NO: 1460 - DNA, 16 bp, Artificial sequence
  Synthetic oligonucleotide
gccgaatatagtagct

SEQ ID NO: 1461 - DNA, 16 bp, Artificial sequence
  Synthetic oligonucleotide
cgaatccaccccgatt

SEQ ID NO: 1462 - DNA, 16 bp, Artificial sequence
  Synthetic oligonucleotide
aggatgcaagaggtta

SEQ ID NO: 1463 - DNA, 16 bp, Artificial sequence
  Synthetic oligonucleotide
ctgacataagttgtat

SEQ ID NO: 1464 - DNA, 16 bp, Artificial sequence
  Synthetic oligonucleotide
gtgagtctacaggcct

SEQ ID NO: 1465 - DNA, 16 bp, Artificial sequence
  Synthetic oligonucleotide
gtggaggaactctgtc

SEQ ID NO: 1466 - DNA, 16 bp, Artificial sequence
  Synthetic oligonucleotide
tcagaatttggcatgc

SEQ ID NO: 1467 - DNA, 16 bp, Artificial sequence
  Synthetic oligonucleotide
aggagttagagtaaga

SEQ ID NO: 1468 - DNA, 16 bp, Artificial sequence
  Synthetic oligonucleotide
taggatgaaggttctg

SEQ ID NO: 1469 - DNA, 16 bp, Artificial sequence
  Synthetic oligonucleotide
gttcggtgtggagtga

SEQ ID NO: 1470 - DNA, 16 bp, Artificial sequence
  Synthetic oligonucleotide
gggttaagagtcaggc

SEQ ID NO: 1471 - DNA, 16 bp, Artificial sequence
  Synthetic oligonucleotide
gtgtgggtatggttgt

SEQ ID NO: 1472 - DNA, 16 bp, Artificial sequence
  Synthetic oligonucleotide
gtacggtgtggaagcc

SEQ ID NO: 1473 - DNA, 16 bp, Artificial sequence
  Synthetic oligonucleotide
atcgggtccttgtcca

SEQ ID NO: 1474 - DNA, 16 bp, Artificial sequence
  Synthetic oligonucleotide
cgcctcgaagatctcg

SEQ ID NO: 1475 - DNA, 16 bp, Artificial sequence
  Synthetic oligonucleotide
agctggtgcatgaaat

SEQ ID NO: 1476 - DNA, 16 bp, Artificial sequence
  Synthetic oligonucleotide
gccggctccctggaca

SEQ ID NO: 1477 - DNA, 16 bp, Artificial sequence
  Synthetic oligonucleotide
tcctctggctcttcga

SEQ ID NO: 1478 - DNA, 16 bp, Artificial sequence
  Synthetic oligonucleotide
cggatgatgccacaga

SEQ ID NO: 1479 - DNA, 16 bp, Artificial sequence
  Synthetic oligonucleotide
tggctaccccacaggt

SEQ ID NO: 1480 - DNA, 16 bp, Artificial sequence
  Synthetic oligonucleotide
cacccgcacaaagcac

SEQ ID NO: 1481 - DNA, 16 bp, Artificial sequence
  Synthetic oligonucleotide
tccttgatcttgaggt

SEQ ID NO: 1482 - DNA, 16 bp, Artificial sequence
  Synthetic oligonucleotide
gcgagcagctgaggca

SEQ ID NO: 1483 - DNA, 16 bp, Artificial sequence
  Synthetic oligonucleotide
ggttgtttgagtgtac

SEQ ID NO: 1484 - DNA, 16 bp, Artificial sequence
  Synthetic oligonucleotide
tgggacctcagatcct

SEQ ID NO: 1485 - DNA, 16 bp, Artificial sequence
  Synthetic oligonucleotide
cagtctaagctgaggc

SEQ ID NO: 1486 - DNA, 16 bp, Artificial sequence
  Synthetic oligonucleotide
ataggagggcgaggat

SEQ ID NO: 1487 - DNA, 16 bp, Artificial sequence
  Synthetic oligonucleotide
tccccaatgtgcctat

SEQ ID NO: 1488 - DNA, 16 bp, Artificial sequence
  Synthetic oligonucleotide
taccagagggcccctg

SEQ ID NO: 1489 - DNA, 16 bp, Artificial sequence
  Synthetic oligonucleotide
ttaagtacttcacctt

SEQ ID NO: 1490 - DNA, 16 bp, Artificial sequence
  Synthetic oligonucleotide
atggcgggagaaagag

SEQ ID NO: 1491 - DNA, 16 bp, Artificial sequence
  Synthetic oligonucleotide
gctctaggctggatgc

SEQ ID NO: 1492 - DNA, 16 bp, Artificial sequence
  Synthetic oligonucleotide
ggcaccttgcaatcct

SEQ ID NO: 1493 - DNA, 16 bp, Artificial sequence
  Synthetic oligonucleotide
taaactacggttgaca

SEQ ID NO: 1494 - DNA, 16 bp, Artificial sequence
  Synthetic oligonucleotide
ccaatatatagcatga

SEQ ID NO: 1495 - DNA, 16 bp, Artificial sequence
  Synthetic oligonucleotide
atccaaggaagcagtc

SEQ ID NO: 1496 - DNA, 16 bp, Artificial sequence
  Synthetic oligonucleotide
aatactcacctagggt

SEQ ID NO: 1497 - DNA, 16 bp, Artificial sequence
  Synthetic oligonucleotide
gcaaatcaataaggga

SEQ ID NO: 1498 - DNA, 16 bp, Artificial sequence
  Synthetic oligonucleotide
gtaggaaaggactttc

SEQ ID NO: 1499 - DNA, 16 bp, Artificial sequence
  Synthetic oligonucleotide
cacacatagggcttgg

SEQ ID NO: 1500 - DNA, 16 bp, Artificial sequence
  Synthetic oligonucleotide
ataagttttaacacct

SEQ ID NO: 1501 - DNA, 16 bp, Artificial sequence
  Synthetic oligonucleotide
actggaggaccatgga

SEQ ID NO: 1502 - DNA, 16 bp, Artificial sequence
  Synthetic oligonucleotide
taaagaagggcaaggt

SEQ ID NO: 1503 - DNA, 16 bp, Artificial sequence
  Synthetic oligonucleotide
agggatacatagagac

SEQ ID NO: 1504 - DNA, 16 bp, Artificial sequence
  Synthetic oligonucleotide
gagtagacaagggcca

SEQ ID NO: 1505 - DNA, 16 bp, Artificial sequence
  Synthetic oligonucleotide
gtccaacctgtgggaa

SEQ ID NO: 1506 - DNA, 16 bp, Artificial sequence
  Synthetic oligonucleotide
ccaatacagagcccat

SEQ ID NO: 1507 - DNA, 16 bp, Artificial sequence
  Synthetic oligonucleotide
tccttggaaccatctg

SEQ ID NO: 1508 - DNA, 16 bp, Artificial sequence
  Synthetic oligonucleotide
ctccacagatactggg

SEQ ID NO: 1509 - DNA, 16 bp, Artificial sequence
  Synthetic oligonucleotide
gggcagataccccacc

SEQ ID NO: 1510 - DNA, 16 bp, Artificial sequence
  Synthetic oligonucleotide
cccgacttgcccagat

SEQ ID NO: 1511 - DNA, 16 bp, Artificial sequence
  Synthetic oligonucleotide
agcatagatacattct

SEQ ID NO: 1512 - DNA, 16 bp, Artificial sequence
  Synthetic oligonucleotide
taccgatttcggtgca

SEQ ID NO: 1513 - DNA, 16 bp, Artificial sequence
  Synthetic oligonucleotide
taagttcttagtctcc

SEQ ID NO: 1514 - DNA, 16 bp, Artificial sequence
  Synthetic oligonucleotide
acttgagaactccact

SEQ ID NO: 1515 - DNA, 16 bp, Artificial sequence
  Synthetic oligonucleotide
gaaagccctccacaat

SEQ ID NO: 1516 - DNA, 16 bp, Artificial sequence
  Synthetic oligonucleotide
atccagcatggcaagt

SEQ ID NO: 1517 - DNA, 16 bp, Artificial sequence
  Synthetic oligonucleotide
gacatgaagagtctgg

SEQ ID NO: 1518 - DNA, 16 bp, Artificial sequence
  Synthetic oligonucleotide
catgggttttagcttg

SEQ ID NO: 1519 - DNA, 16 bp, Artificial sequence
  Synthetic oligonucleotide
gaggctattgtaacag

SEQ ID NO: 1520 - DNA, 16 bp, Artificial sequence
  Synthetic oligonucleotide
gagggcaatggttgtt

SEQ ID NO: 1521 - DNA, 16 bp, Artificial sequence
  Synthetic oligonucleotide
ctcgaccacctgagcc

SEQ ID NO: 1522 - DNA, 16 bp, Artificial sequence
  Synthetic oligonucleotide
aaccacttcctgtgcc

SEQ ID NO: 1523 - DNA, 16 bp, Artificial sequence
  Synthetic oligonucleotide
ggagatcgagtaactt

SEQ ID NO: 1524 - DNA, 16 bp, Artificial sequence
  Synthetic oligonucleotide
catacctggtgcatga

SEQ ID NO: 1525 - DNA, 16 bp, Artificial sequence
  Synthetic oligonucleotide
ctgcaattcagaatag

SEQ ID NO: 1526 - DNA, 16 bp, Artificial sequence
  Synthetic oligonucleotide
cgcaggtgctgacatt

SEQ ID NO: 1527 - DNA, 16 bp, Artificial sequence
  Synthetic oligonucleotide
ccacaaggcctctcat

SEQ ID NO: 1528 - DNA, 16 bp, Artificial sequence
  Synthetic oligonucleotide
tcgagagaagctaagt

SEQ ID NO: 1529 - DNA, 16 bp, Artificial sequence
  Synthetic oligonucleotide
tgggaacagtggaata

SEQ ID NO: 1530 - DNA, 16 bp, Artificial sequence
  Synthetic oligonucleotide
actcaccacttgagcc

SEQ ID NO: 1531 - DNA, 16 bp, Artificial sequence
  Synthetic oligonucleotide
tgcgcactatccctat

SEQ ID NO: 1532 - DNA, 16 bp, Artificial sequence
  Synthetic oligonucleotide
gtcgctcaccacagat

SEQ ID NO: 1533 - DNA, 16 bp, Artificial sequence
  Synthetic oligonucleotide
ctggcaagtctggcta

SEQ ID NO: 1534 - DNA, 16 bp, Artificial sequence
  Synthetic oligonucleotide
gctctttaccacccaa

SEQ ID NO: 1535 - DNA, 16 bp, Artificial sequence
  Synthetic oligonucleotide
cattcttacctgggaa

SEQ ID NO: 1536 - DNA, 16 bp, Artificial sequence
  Synthetic oligonucleotide
ggaagcttttgtgagc

SEQ ID NO: 1537 - DNA, 16 bp, Artificial sequence
  Synthetic oligonucleotide
ggccgaatatagtagc

SEQ ID NO: 1538 - DNA, 16 bp, Artificial sequence
  Synthetic oligonucleotide
gcgaatccaccccgat

SEQ ID NO: 1539 - DNA, 16 bp, Artificial sequence
  Synthetic oligonucleotide
aaggatgcaagaggtt

SEQ ID NO: 1540 - DNA, 16 bp, Artificial sequence
  Synthetic oligonucleotide
cctgacataagttgta

SEQ ID NO: 1541 - DNA, 16 bp, Artificial sequence
  Synthetic oligonucleotide
acaaggtgagtctaca

SEQ ID NO: 1542 - DNA, 16 bp, Artificial sequence
  Synthetic oligonucleotide
acccagcggatgagcg

SEQ ID NO: 1543 - DNA, 16 bp, Artificial sequence
  Synthetic oligonucleotide
gtcagaatttggcatg

SEQ ID NO: 1544 - DNA, 16 bp, Artificial sequence
  Synthetic oligonucleotide
aaggagttagagtaag

SEQ ID NO: 1545 - DNA, 16 bp, Artificial sequence
  Synthetic oligonucleotide
ctaggatgaaggttct

SEQ ID NO: 1546 - DNA, 16 bp, Artificial sequence
  Synthetic oligonucleotide
ggttcggtgtggagtg

SEQ ID NO: 1547 - DNA, 16 bp, Artificial sequence
  Synthetic oligonucleotide
tgggttaagagtcagg

SEQ ID NO: 1548 - DNA, 16 bp, Artificial sequence
  Synthetic oligonucleotide
ggttagatgggtgtgg

SEQ ID NO: 1549 - DNA, 16 bp, Artificial sequence
  Synthetic oligonucleotide
tgtacggtgtggaagc

SEQ ID NO: 1550 - DNA, 16 bp, Artificial sequence
  Synthetic oligonucleotide
catcgggtccttgtcc

SEQ ID NO: 1551 - DNA, 16 bp, Artificial sequence
  Synthetic oligonucleotide
ccgcctcgaagatctc

SEQ ID NO: 1552 - DNA, 16 bp, Artificial sequence
  Synthetic oligonucleotide
tgagagctggtgcatg

SEQ ID NO: 1553 - DNA, 16 bp, Artificial sequence
  Synthetic oligonucleotide
gtgccggctccctgga

SEQ ID NO: 1554 - DNA, 16 bp, Artificial sequence
  Synthetic oligonucleotide
ggaagtcctctggctc

SEQ ID NO: 1555 - DNA, 16 bp, Artificial sequence
  Synthetic oligonucleotide
gtcggatgatgccaca

SEQ ID NO: 1556 - DNA, 16 bp, Artificial sequence
  Synthetic oligonucleotide
tccatggctaccccac

SEQ ID NO: 1557 - DNA, 16 bp, Artificial sequence
  Synthetic oligonucleotide
ccacccgcacaaagca

SEQ ID NO: 1558 - DNA, 16 bp, Artificial sequence
  Synthetic oligonucleotide
ttccttgatcttgagg

SEQ ID NO: 1559 - DNA, 16 bp, Artificial sequence
  Synthetic oligonucleotide
tgcgagcagctgaggc

SEQ ID NO: 1560 - DNA, 16 bp, Artificial sequence
  Synthetic oligonucleotide
aggttgtttgagtgta

SEQ ID NO: 1561 - DNA, 16 bp, Artificial sequence
  Synthetic oligonucleotide
ttgggacctcagatcc

SEQ ID NO: 1562 - DNA, 16 bp, Artificial sequence
  Synthetic oligonucleotide
gcagtctaagctgagg

SEQ ID NO: 1563 - DNA, 16 bp, Artificial sequence
  Synthetic oligonucleotide
gataggagggcgagga

SEQ ID NO: 1564 - DNA, 16 bp, Artificial sequence
  Synthetic oligonucleotide
ctccccaatgtgccta

SEQ ID NO: 1565 - DNA, 16 bp, Artificial sequence
  Synthetic oligonucleotide
gctgggtacatcccac

SEQ ID NO: 1566 - DNA, 16 bp, Artificial sequence
  Synthetic oligonucleotide
cattaagtacttcacc

SEQ ID NO: 1567 - DNA, 16 bp, Artificial sequence
  Synthetic oligonucleotide
gatggcgggagaaaga

SEQ ID NO: 1568 - DNA, 16 bp, Artificial sequence
  Synthetic oligonucleotide
agctctaggctggatg

SEQ ID NO: 1569 - DNA, 16 bp, Artificial sequence
  Synthetic oligonucleotide
cccggcaccttgcaat

SEQ ID NO: 1570 - DNA, 16 bp, Artificial sequence
  Synthetic oligonucleotide
ctaaactacggttgac

SEQ ID NO: 1571 - DNA, 16 bp, Artificial sequence
  Synthetic oligonucleotide
gttaattgaataaagc

SEQ ID NO: 1572 - DNA, 16 bp, Artificial sequence
  Synthetic oligonucleotide
cccttttcaggaatcc

SEQ ID NO: 1573 - DNA, 16 bp, Artificial sequence
  Synthetic oligonucleotide
taatactcacctaggg

SEQ ID NO: 1574 - DNA, 16 bp, Artificial sequence
  Synthetic oligonucleotide
tggcaaatcaataagg

SEQ ID NO: 1575 - DNA, 16 bp, Artificial sequence
  Synthetic oligonucleotide
caagtaggaaaggact

SEQ ID NO: 1576 - DNA, 16 bp, Artificial sequence
  Synthetic oligonucleotide
tcacacatagggcttg

SEQ ID NO: 1577 - DNA, 16 bp, Artificial sequence
  Synthetic oligonucleotide
ccattcaagatataag

SEQ ID NO: 1578 - DNA, 16 bp, Artificial sequence
  Synthetic oligonucleotide
aactggaggaccatgg

SEQ ID NO: 1579 - DNA, 16 bp, Artificial sequence
  Synthetic oligonucleotide
tcaactgatgctgcct

SEQ ID NO: 1580 - DNA, 16 bp, Artificial sequence
  Synthetic oligonucleotide
tagggatacatagaga

SEQ ID NO: 1581 - DNA, 16 bp, Artificial sequence
  Synthetic oligonucleotide
actgagcacggagagg

SEQ ID NO: 1582 - DNA, 16 bp, Artificial sequence
  Synthetic oligonucleotide
ccccacactgtgatcg

SEQ ID NO: 1583 - DNA, 16 bp, Artificial sequence
  Synthetic oligonucleotide
cgccaatacagagccc

SEQ ID NO: 1584 - DNA, 16 bp, Artificial sequence
  Synthetic oligonucleotide
ctccttggaaccatct

SEQ ID NO: 1585 - DNA, 16 bp, Artificial sequence
  Synthetic oligonucleotide
caggctccacagatac

SEQ ID NO: 1586 - DNA, 16 bp, Artificial sequence
  Synthetic oligonucleotide
agggcagataccccac

SEQ ID NO: 1587 - DNA, 16 bp, Artificial sequence
  Synthetic oligonucleotide
cccccgacttgcccag

SEQ ID NO: 1588 - DNA, 16 bp, Artificial sequence
  Synthetic oligonucleotide
aagcatagatacattc

SEQ ID NO: 1589 - DNA, 16 bp, Artificial sequence
  Synthetic oligonucleotide
ataccgatttcggtgc

SEQ ID NO: 1590 - DNA, 16 bp, Artificial sequence
  Synthetic oligonucleotide
ttaagttcttagtctc

SEQ ID NO: 1591 - DNA, 16 bp, Artificial sequence
  Synthetic oligonucleotide
gacttgagaactccac

SEQ ID NO: 1592 - DNA, 16 bp, Artificial sequence
  Synthetic oligonucleotide
ttgaaagccctccaca

SEQ ID NO: 1593 - DNA, 16 bp, Artificial sequence
  Synthetic oligonucleotide
acggatccagcatggc

SEQ ID NO: 1594 - DNA, 16 bp, Artificial sequence
  Synthetic oligonucleotide
agacatgaagagtctg

SEQ ID NO: 1595 - DNA, 16 bp, Artificial sequence
  Synthetic oligonucleotide
agtcaaagtgacatgg

SEQ ID NO: 1596 - DNA, 16 bp, Artificial sequence
  Synthetic oligonucleotide
aggaggctattgtaac

SEQ ID NO: 1597 - DNA, 16 bp, Artificial sequence
  Synthetic oligonucleotide
tgagggcaatggttgt

SEQ ID NO: 1598 - DNA, 16 bp, Artificial sequence
  Synthetic oligonucleotide
actcgaccacctgagc

SEQ ID NO: 1599 - DNA, 16 bp, Artificial sequence
  Synthetic oligonucleotide
acccagaaaccacttc

SEQ ID NO: 1600 - DNA, 16 bp, Artificial sequence
  Synthetic oligonucleotide
tggagatcgagtaact

SEQ ID NO: 1601 - DNA, 16 bp, Artificial sequence
  Synthetic oligonucleotide
ccatacctggtgcatg

SEQ ID NO: 1602 - DNA, 16 bp, Artificial sequence
  Synthetic oligonucleotide
cagagtactgcaattc

SEQ ID NO: 1603 - DNA, 16 bp, Artificial sequence
  Synthetic oligonucleotide
tcgcaggtgctgacat

SEQ ID NO: 1604 - DNA, 16 bp, Artificial sequence
  Synthetic oligonucleotide
acctatggaggctgtg

SEQ ID NO: 1605 - DNA, 16 bp, Artificial sequence
  Synthetic oligonucleotide
aggtcgagagaagcta

SEQ ID NO: 1606 - DNA, 16 bp, Artificial sequence
  Synthetic oligonucleotide
ttgggaacagtggaat

SEQ ID NO: 1607 - DNA, 16 bp, Artificial sequence
  Synthetic oligonucleotide
ctgcatgtcaggcctg

SEQ ID NO: 1608 - DNA, 16 bp, Artificial sequence
  Synthetic oligonucleotide
ttgcgcactatcccta

SEQ ID NO: 1609 - DNA, 16 bp, Artificial sequence
  Synthetic oligonucleotide
ggtcgctcaccacaga

SEQ ID NO: 1610 - DNA, 16 bp, Artificial sequence
  Synthetic oligonucleotide
catagctggtcctgct

SEQ ID NO: 1611 - DNA, 16 bp, Artificial sequence
  Synthetic oligonucleotide
atagggctctttacca

SEQ ID NO: 1612 - DNA, 16 bp, Artificial sequence
  Synthetic oligonucleotide
ccattcttacctggga

SEQ ID NO: 1613 - DNA, 16 bp, Artificial sequence
  Synthetic oligonucleotide
cgaaaggaagcttttg

SEQ ID NO: 1614 - DNA, 16 bp, Artificial sequence
  Synthetic oligonucleotide
tggccgaatatagtag

SEQ ID NO: 1615 - DNA, 16 bp, Artificial sequence
  Synthetic oligonucleotide
ggcgaatccaccccga

SEQ ID NO: 1616 - DNA, 16 bp, Artificial sequence
  Synthetic oligonucleotide
ccaaaggatgcaagag

SEQ ID NO: 1617 - DNA, 16 bp, Artificial sequence
  Synthetic oligonucleotide
acctgacataagttgt

SEQ ID NO: 1618 - DNA, 16 bp, Artificial sequence
  Synthetic oligonucleotide
tacaaggtgagtctac

SEQ ID NO: 1619 - DNA, 16 bp, Artificial sequence
  Synthetic oligonucleotide
cttacccagcggatga

SEQ ID NO: 1620 - DNA, 16 bp, Artificial sequence
  Synthetic oligonucleotide
tagggtcagaatttgg

SEQ ID NO: 1621 - DNA, 16 bp, Artificial sequence
  Synthetic oligonucleotide
gaaggagttagagtaa

SEQ ID NO: 1622 - DNA, 16 bp, Artificial sequence
  Synthetic oligonucleotide
gctaggatgaaggttc

SEQ ID NO: 1623 - DNA, 16 bp, Artificial sequence
  Synthetic oligonucleotide
gggttcggtgtggagt

SEQ ID NO: 1624 - DNA, 16 bp, Artificial sequence
  Synthetic oligonucleotide
gtgggttaagagtcag

SEQ ID NO: 1625 - DNA, 16 bp, Artificial sequence
  Synthetic oligonucleotide
caggactagatgtggg

SEQ ID NO: 1626 - DNA, 16 bp, Artificial sequence
  Synthetic oligonucleotide
gctgtacggtgtggaa

SEQ ID NO: 1627 - DNA, 16 bp, Artificial sequence
  Synthetic oligonucleotide
gcatcgggtccttgtc

SEQ ID NO: 1628 - DNA, 16 bp, Artificial sequence
  Synthetic oligonucleotide
cccgcctcgaagatct

SEQ ID NO: 1629 - DNA, 16 bp, Artificial sequence
  Synthetic oligonucleotide
ttgagagctggtgcat

SEQ ID NO: 1630 - DNA, 16 bp, Artificial sequence
  Synthetic oligonucleotide
gcagtgccggctccct

SEQ ID NO: 1631 - DNA, 16 bp, Artificial sequence
  Synthetic oligonucleotide
tgaggaagtcctctgg

SEQ ID NO: 1632 - DNA, 16 bp, Artificial sequence
  Synthetic oligonucleotide
tgtcggatgatgccac

SEQ ID NO: 1633 - DNA, 16 bp, Artificial sequence
  Synthetic oligonucleotide
tctgggaatgtgctgt

SEQ ID NO: 1634 - DNA, 16 bp, Artificial sequence
  Synthetic oligonucleotide
tccacccgcacaaagc

SEQ ID NO: 1635 - DNA, 16 bp, Artificial sequence
  Synthetic oligonucleotide
agtttggcccctgttc

SEQ ID NO: 1636 - DNA, 16 bp, Artificial sequence
  Synthetic oligonucleotide
tgtgcgagcagctgag

SEQ ID NO: 1637 - DNA, 16 bp, Artificial sequence
  Synthetic oligonucleotide
ttgaggttgtttgagt

SEQ ID NO: 1638 - DNA, 16 bp, Artificial sequence
  Synthetic oligonucleotide
gtgttgggacctcaga

SEQ ID NO: 1639 - DNA, 16 bp, Artificial sequence
  Synthetic oligonucleotide
gtagttcctctgcagt

SEQ ID NO: 1640 - DNA, 16 bp, Artificial sequence
  Synthetic oligonucleotide
ggataggagggcgagg

SEQ ID NO: 1641 - DNA, 16 bp, Artificial sequence
  Synthetic oligonucleotide
cctccccaatgtgcct

SEQ ID NO: 1642 - DNA, 16 bp, Artificial sequence
  Synthetic oligonucleotide
agctgggtacatccca

SEQ ID NO: 1643 - DNA, 16 bp, Artificial sequence
  Synthetic oligonucleotide
gcattaagtacttcac

SEQ ID NO: 1644 - DNA, 16 bp, Artificial sequence
  Synthetic oligonucleotide
cagatggcgggagaaa

SEQ ID NO: 1645 - DNA, 16 bp, Artificial sequence
  Synthetic oligonucleotide
caaagctctaggctgg

SEQ ID NO: 1646 - DNA, 16 bp, Artificial sequence
  Synthetic oligonucleotide
gccccggcaccttgca

SEQ ID NO: 1647 - DNA, 16 bp, Artificial sequence
  Synthetic oligonucleotide
gctaaactacggttga

SEQ ID NO: 1648 - DNA, 16 bp, Artificial sequence
  Synthetic oligonucleotide
gcttcaaaaacactac

SEQ ID NO: 1649 - DNA, 16 bp, Artificial sequence
  Synthetic oligonucleotide
gcaactcccttttcag

SEQ ID NO: 1650 - DNA, 16 bp, Artificial sequence
  Synthetic oligonucleotide
ataatactcacctagg

SEQ ID NO: 1651 - DNA, 16 bp, Artificial sequence
  Synthetic oligonucleotide
gtggcaaatcaataag

SEQ ID NO: 1652 - DNA, 16 bp, Artificial sequence
  Synthetic oligonucleotide
ggtgaacatttatctc

SEQ ID NO: 1653 - DNA, 16 bp, Artificial sequence
  Synthetic oligonucleotide
aatcacacatagggct

SEQ ID NO: 1654 - DNA, 16 bp, Artificial sequence
  Synthetic oligonucleotide
ccagatccattcaaga

SEQ ID NO: 1655 - DNA, 16 bp, Artificial sequence
  Synthetic oligonucleotide
aaactggaggaccatg

SEQ ID NO: 1656 - DNA, 16 bp, Artificial sequence
  Synthetic oligonucleotide
ttcaactgatgctgcc

SEQ ID NO: 1657 - DNA, 16 bp, Artificial sequence
  Synthetic oligonucleotide
atagggatacatagag

SEQ ID NO: 1658 - DNA, 16 bp, Artificial sequence
  Synthetic oligonucleotide
ccttctacactgagca

SEQ ID NO: 1659 - DNA, 16 bp, Artificial sequence
  Synthetic oligonucleotide
gcccagctcttgtgag

SEQ ID NO: 1660 - DNA, 16 bp, Artificial sequence
  Synthetic oligonucleotide
tcgccaatacagagcc

SEQ ID NO: 1661 - DNA, 16 bp, Artificial sequence
  Synthetic oligonucleotide
caaactccttggaacc

SEQ ID NO: 1662 - DNA, 16 bp, Artificial sequence
  Synthetic oligonucleotide
agctctgagagtgcca

SEQ ID NO: 1663 - DNA, 16 bp, Artificial sequence
  Synthetic oligonucleotide
gagggcagatacccca

SEQ ID NO: 1664 - DNA, 16 bp, Artificial sequence
  Synthetic oligonucleotide
gcccccgacttgccca

SEQ ID NO: 1665 - DNA, 16 bp, Artificial sequence
  Synthetic oligonucleotide
gcaaagcatagataca

SEQ ID NO: 1666 - DNA, 16 bp, Artificial sequence
  Synthetic oligonucleotide
aataccgatttcggtg

SEQ ID NO: 1667 - DNA, 16 bp, Artificial sequence
  Synthetic oligonucleotide
attaagttcttagtct

SEQ ID NO: 1668 - DNA, 16 bp, Artificial sequence
  Synthetic oligonucleotide
tgacttgagaactcca

SEQ ID NO: 1669 - DNA, 16 bp, Artificial sequence
  Synthetic oligonucleotide
cttgaaagccctccac

SEQ ID NO: 1670 - DNA, 16 bp, Artificial sequence
  Synthetic oligonucleotide
cacggatccagcatgg

SEQ ID NO: 1671 - DNA, 16 bp, Artificial sequence
  Synthetic oligonucleotide
gatagacatgaagagt

SEQ ID NO: 1672 - DNA, 16 bp, Artificial sequence
  Synthetic oligonucleotide
agcttggatgtagtgg

SEQ ID NO: 1673 - DNA, 16 bp, Artificial sequence
  Synthetic oligonucleotide
gaggaggctattgtaa

SEQ ID NO: 1674 - DNA, 16 bp, Artificial sequence
  Synthetic oligonucleotide
atgagggcaatggttg

SEQ ID NO: 1675 - DNA, 16 bp, Artificial sequence
  Synthetic oligonucleotide
tactcgaccacctgag

SEQ ID NO: 1676 - DNA, 16 bp, Artificial sequence
  Synthetic oligonucleotide
agacttgcctgggacc

SEQ ID NO: 1677 - DNA, 16 bp, Artificial sequence
  Synthetic oligonucleotide
atggagatcgagtaac

SEQ ID NO: 1678 - DNA, 16 bp, Artificial sequence
  Synthetic oligonucleotide
tccatacctggtgcat

SEQ ID NO: 1679 - DNA, 16 bp, Artificial sequence
  Synthetic oligonucleotide
cctgacacctttgacc

SEQ ID NO: 1680 - DNA, 16 bp, Artificial sequence
  Synthetic oligonucleotide
ttcgcaggtgctgaca

SEQ ID NO: 1681 - DNA, 16 bp, Artificial sequence
  Synthetic oligonucleotide
gttgatccctgtgggt

SEQ ID NO: 1682 - DNA, 16 bp, Artificial sequence
  Synthetic oligonucleotide
atacatacgagaaaac

SEQ ID NO: 1683 - DNA, 16 bp, Artificial sequence
  Synthetic oligonucleotide
aactttgggaacagtg

SEQ ID NO: 1684 - DNA, 16 bp, Artificial sequence
  Synthetic oligonucleotide
taacacatgcccctca

SEQ ID NO: 1685 - DNA, 16 bp, Artificial sequence
  Synthetic oligonucleotide
ttttgcgcactatccc

SEQ ID NO: 1686 - DNA, 16 bp, Artificial sequence
  Synthetic oligonucleotide
tctgagtctgccacca

SEQ ID NO: 1687 - DNA, 16 bp, Artificial sequence
  Synthetic oligonucleotide
acatagctggtcctgc

SEQ ID NO: 1688 - DNA, 16 bp, Artificial sequence
  Synthetic oligonucleotide
aatagggctctttacc

SEQ ID NO: 1689 - DNA, 16 bp, Artificial sequence
  Synthetic oligonucleotide
gaccattcttacctgg

SEQ ID NO: 1690 - DNA, 16 bp, Artificial sequence
  Synthetic oligonucleotide
ccgaaaggaagctttt

SEQ ID NO: 1691 - DNA, 16 bp, Artificial sequence
  Synthetic oligonucleotide
cttctgatggccgaat

SEQ ID NO: 1692 - DNA, 16 bp, Artificial sequence
  Synthetic oligonucleotide
gggcgaatccaccccg

SEQ ID NO: 1693 - DNA, 16 bp, Artificial sequence
  Synthetic oligonucleotide
accaaaggatgcaaga

SEQ ID NO: 1694 - DNA, 16 bp, Artificial sequence
  Synthetic oligonucleotide
cacctgacataagttg

SEQ ID NO: 1695 - DNA, 16 bp, Artificial sequence
  Synthetic oligonucleotide
ctacaaggtgagtcta

SEQ ID NO: 1696 - DNA, 16 bp, Artificial sequence
  Synthetic oligonucleotide
gcttacccagcggatg

SEQ ID NO: 1697 - DNA, 16 bp, Artificial sequence
  Synthetic oligonucleotide
ttagggtcagaatttg

SEQ ID NO: 1698 - DNA, 16 bp, Artificial sequence
  Synthetic oligonucleotide
ggaaggagttagagta

SEQ ID NO: 1699 - DNA, 16 bp, Artificial sequence
  Synthetic oligonucleotide
cgctaggatgaaggtt

SEQ ID NO: 1700 - DNA, 16 bp, Artificial sequence
  Synthetic oligonucleotide
tgaggttagttgtggg

SEQ ID NO: 1701 - DNA, 16 bp, Artificial sequence
  Synthetic oligonucleotide
ggtgggttaagagtca

SEQ ID NO: 1702 - DNA, 16 bp, Artificial sequence
  Synthetic oligonucleotide
acaggactagatgtgg

SEQ ID NO: 1703 - DNA, 16 bp, Artificial sequence
  Synthetic oligonucleotide
acttgaggaagtcctc

SEQ ID NO: 1704 - DNA, 16 bp, Artificial sequence
  Synthetic oligonucleotide
cacgctgtacggtgtg

SEQ ID NO: 1705 - DNA, 16 bp, Artificial sequence
  Synthetic oligonucleotide
ccgagggcttgccagg

SEQ ID NO: 1706 - DNA, 16 bp, Artificial sequence
  Synthetic oligonucleotide
ccccgcctcgaagatc

SEQ ID NO: 1707 - DNA, 16 bp, Artificial sequence
  Synthetic oligonucleotide
gttgagagctggtgca

SEQ ID NO: 1708 - DNA, 16 bp, Artificial sequence
  Synthetic oligonucleotide
gcagagcagtgccggc

SEQ ID NO: 1709 - DNA, 16 bp, Artificial sequence
  Synthetic oligonucleotide
ttgaggaagtcctctg

SEQ ID NO: 1710 - DNA, 16 bp, Artificial sequence
  Synthetic oligonucleotide
ttgtcggatgatgcca

SEQ ID NO: 1711 - DNA, 16 bp, Artificial sequence
  Synthetic oligonucleotide
gtggaggaactctggg

SEQ ID NO: 1712 - DNA, 16 bp, Artificial sequence
  Synthetic oligonucleotide
ctccacccgcacaaag

SEQ ID NO: 1713 - DNA, 16 bp, Artificial sequence
  Synthetic oligonucleotide
cagtttggcccctgtt

SEQ ID NO: 1714 - DNA, 16 bp, Artificial sequence
  Synthetic oligonucleotide
ctgtgcgagcagctga

SEQ ID NO: 1715 - DNA, 16 bp, Artificial sequence
  Synthetic oligonucleotide
gctttgaggttgtttg

SEQ ID NO: 1716 - DNA, 16 bp, Artificial sequence
  Synthetic oligonucleotide
cgtgttgggacctcag

SEQ ID NO: 1717 - DNA, 16 bp, Artificial sequence
  Synthetic oligonucleotide
gagtagttcctctgca

SEQ ID NO: 1718 - DNA, 16 bp, Artificial sequence
  Synthetic oligonucleotide
gacagagggtgtcagg

SEQ ID NO: 1719 - DNA, 16 bp, Artificial sequence
  Synthetic oligonucleotide
tcctccccaatgtgcc

SEQ ID NO: 1720 - DNA, 16 bp, Artificial sequence
  Synthetic oligonucleotide
gtagctgggtacatcc

SEQ ID NO: 1721 - DNA, 16 bp, Artificial sequence
  Synthetic oligonucleotide
gcccatgcattaagta

SEQ ID NO: 1722 - DNA, 16 bp, Artificial sequence
  Synthetic oligonucleotide
acagatggcgggagaa

SEQ ID NO: 1723 - DNA, 16 bp, Artificial sequence
  Synthetic oligonucleotide
acaaagctctaggctg

SEQ ID NO: 1724 - DNA, 16 bp, Artificial sequence
  Synthetic oligonucleotide
aagtgctcagcttgcc

SEQ ID NO: 1725 - DNA, 16 bp, Artificial sequence
  Synthetic oligonucleotide
agctaaactacggttg

SEQ ID NO: 1726 - DNA, 16 bp, Artificial sequence
  Synthetic oligonucleotide
gaggacagtcttgtcc

SEQ ID NO: 1727 - DNA, 16 bp, Artificial sequence
  Synthetic oligonucleotide
cacgccccctttgccc

SEQ ID NO: 1728 - DNA, 16 bp, Artificial sequence
  Synthetic oligonucleotide
aataatactcacctag

SEQ ID NO: 1729 - DNA, 16 bp, Artificial sequence
  Synthetic oligonucleotide
gctgtggcaaatcaat

SEQ ID NO: 1730 - DNA, 16 bp, Artificial sequence
  Synthetic oligonucleotide
cataggtgaacattta

SEQ ID NO: 1731 - DNA, 16 bp, Artificial sequence
  Synthetic oligonucleotide
taagtgcctggctaaa

SEQ ID NO: 1732 - DNA, 16 bp, Artificial sequence
  Synthetic oligonucleotide
cccagatccattcaag

SEQ ID NO: 1733 - DNA, 16 bp, Artificial sequence
  Synthetic oligonucleotide
caaactggaggaccat

SEQ ID NO: 1734 - DNA, 16 bp, Artificial sequence
  Synthetic oligonucleotide
gttcaactgatgctgc

SEQ ID NO: 1735 - DNA, 16 bp, Artificial sequence
  Synthetic oligonucleotide
gatagggatacataga

SEQ ID NO: 1736 - DNA, 16 bp, Artificial sequence
  Synthetic oligonucleotide
cccttctacactgagc

SEQ ID NO: 1737 - DNA, 16 bp, Artificial sequence
  Synthetic oligonucleotide
tcacctagcccagctc

SEQ ID NO: 1738 - DNA, 16 bp, Artificial sequence
  Synthetic oligonucleotide
ttcgccaatacagagc

SEQ ID NO: 1739 - DNA, 16 bp, Artificial sequence
  Synthetic oligonucleotide
gtccaaactccttgga

SEQ ID NO: 1740 - DNA, 16 bp, Artificial sequence
  Synthetic oligonucleotide
aggtttgaagctctga

SEQ ID NO: 1741 - DNA, 16 bp, Artificial sequence
  Synthetic oligonucleotide
agagggcagatacccc

SEQ ID NO: 1742 - DNA, 16 bp, Artificial sequence
  Synthetic oligonucleotide
agcccccgacttgccc

SEQ ID NO: 1743 - DNA, 16 bp, Artificial sequence
  Synthetic oligonucleotide
agcaaagcatagatac

SEQ ID NO: 1744 - DNA, 16 bp, Artificial sequence
  Synthetic oligonucleotide
taataccgatttcggt

SEQ ID NO: 1745 - DNA, 16 bp, Artificial sequence
  Synthetic oligonucleotide
tattaagttcttagtc

SEQ ID NO: 1746 - DNA, 16 bp, Artificial sequence
  Synthetic oligonucleotide
agtgacttgagaactc

SEQ ID NO: 1747 - DNA, 16 bp, Artificial sequence
  Synthetic oligonucleotide
accttgaaagccctcc

SEQ ID NO: 1748 - DNA, 16 bp, Artificial sequence
  Synthetic oligonucleotide
gcacggatccagcatg

SEQ ID NO: 1749 - DNA, 16 bp, Artificial sequence
  Synthetic oligonucleotide
gtagatagacatgaag

SEQ ID NO: 1750 - DNA, 16 bp, Artificial sequence
  Synthetic oligonucleotide
cagcttggatgtagtg

SEQ ID NO: 1751 - DNA, 16 bp, Artificial sequence
  Synthetic oligonucleotide
agattcatctggctgc

SEQ ID NO: 1752 - DNA, 16 bp, Artificial sequence
  Synthetic oligonucleotide
tatgagggcaatggtt

SEQ ID NO: 1753 - DNA, 16 bp, Artificial sequence
  Synthetic oligonucleotide
atactcgaccacctga

SEQ ID NO: 1754 - DNA, 16 bp, Artificial sequence
  Synthetic oligonucleotide
tcacagacttgcctgg

SEQ ID NO: 1755 - DNA, 16 bp, Artificial sequence
  Synthetic oligonucleotide
cgtatggaaactgagg

SEQ ID NO: 1756 - DNA, 16 bp, Artificial sequence
  Synthetic oligonucleotide
cgtccatacctggtgc

SEQ ID NO: 1757 - DNA, 16 bp, Artificial sequence
  Synthetic oligonucleotide
acctgacacctttgac

SEQ ID NO: 1758 - DNA, 16 bp, Artificial sequence
  Synthetic oligonucleotide
attcgcaggtgctgac

SEQ ID NO: 1759 - DNA, 16 bp, Artificial sequence
  Synthetic oligonucleotide
ttatacatacgagaaa

SEQ ID NO: 1760 - DNA, 16 bp, Artificial sequence
  Synthetic oligonucleotide
tagaactttgggaaca

SEQ ID NO: 1761 - DNA, 16 bp, Artificial sequence
  Synthetic oligonucleotide
cttaacacatgcccct

SEQ ID NO: 1762 - DNA, 16 bp, Artificial sequence
  Synthetic oligonucleotide
agaaggttttgcgcac

SEQ ID NO: 1763 - DNA, 16 bp, Artificial sequence
  Synthetic oligonucleotide
gttaggttccctgcac

SEQ ID NO: 1764 - DNA, 16 bp, Artificial sequence
  Synthetic oligonucleotide
tacatagctggtcctg

SEQ ID NO: 1765 - DNA, 16 bp, Artificial sequence
  Synthetic oligonucleotide
gaatagggctctttac

SEQ ID NO: 1766 - DNA, 16 bp, Artificial sequence
  Synthetic oligonucleotide
ggaccattcttacctg

SEQ ID NO: 1767 - DNA, 16 bp, Artificial sequence
  Synthetic oligonucleotide
cccgaaaggaagcttt

SEQ ID NO: 1768 - DNA, 16 bp, Artificial sequence
  Synthetic oligonucleotide
cccttctgatggccga

SEQ ID NO: 1769 - DNA, 16 bp, Artificial sequence
  Synthetic oligonucleotide
cgggcgaatccacccc

SEQ ID NO: 1770 - DNA, 16 bp, Artificial sequence
  Synthetic oligonucleotide
caccaaaggatgcaag

SEQ ID NO: 1771 - DNA, 16 bp, Artificial sequence
  Synthetic oligonucleotide
gcacctgacataagtt

SEQ ID NO: 1772 - DNA, 16 bp, Artificial sequence
  Synthetic oligonucleotide
cctacaaggtgagtct

SEQ ID NO: 1773 - DNA, 16 bp, Artificial sequence
  Synthetic oligonucleotide
tgcttacccagcggat

SEQ ID NO: 1774 - DNA, 16 bp, Artificial sequence
  Synthetic oligonucleotide
gtttagggtcagaatt

SEQ ID NO: 1775 - DNA, 16 bp, Artificial sequence
  Synthetic oligonucleotide
gggaaggagttagagt

SEQ ID NO: 1776 - DNA, 16 bp, Artificial sequence
  Synthetic oligonucleotide
gcgctaggatgaaggt

SEQ ID NO: 1777 - DNA, 16 bp, Artificial sequence
  Synthetic oligonucleotide
gatgaggttagttgtg

SEQ ID NO: 1778 - DNA, 16 bp, Artificial sequence
  Synthetic oligonucleotide
caacttaagggtcagg

SEQ ID NO: 1779 - DNA, 16 bp, Artificial sequence
  Synthetic oligonucleotide
gacaggactagatgtg

SEQ ID NO: 1780 - DNA, 16 bp, Artificial sequence
  Synthetic oligonucleotide
accacgctgtacggtg

SEQ ID NO: 1781 - DNA, 16 bp, Artificial sequence
  Synthetic oligonucleotide
gccgagggcttgccag

SEQ ID NO: 1782 - DNA, 16 bp, Artificial sequence
  Synthetic oligonucleotide
gccccgcctcgaagat

SEQ ID NO: 1783 - DNA, 16 bp, Artificial sequence
  Synthetic oligonucleotide
ccgttgagagctggtg

SEQ ID NO: 1784 - DNA, 16 bp, Artificial sequence
  Synthetic oligonucleotide
gtgcagagcagtgccg

SEQ ID NO: 1785 - DNA, 16 bp, Artificial sequence
  Synthetic oligonucleotide
gcttgaggaagtcctc

SEQ ID NO: 1786 - DNA, 16 bp, Artificial sequence
  Synthetic oligonucleotide
cttgtcggatgatgcc

SEQ ID NO: 1787 - DNA, 16 bp, Artificial sequence
  Synthetic oligonucleotide
catgttgtggaggaac

SEQ ID NO: 1788 - DNA, 16 bp, Artificial sequence
  Synthetic oligonucleotide
ctctccacccgcacaa

SEQ ID NO: 1789 - DNA, 16 bp, Artificial sequence
  Synthetic oligonucleotide
ccagtttggcccctgt

SEQ ID NO: 1790 - DNA, 16 bp, Artificial sequence
  Synthetic oligonucleotide
tctgtgcgagcagctg

SEQ ID NO: 1791 - DNA, 16 bp, Artificial sequence
  Synthetic oligonucleotide
cagctttgaggttgtt

SEQ ID NO: 1792 - DNA, 16 bp, Artificial sequence
  Synthetic oligonucleotide
caggccgtgtgtgtga

SEQ ID NO: 1793 - DNA, 16 bp, Artificial sequence
  Synthetic oligonucleotide
tgagtagttcctctgc

SEQ ID NO: 1794 - DNA, 16 bp, Artificial sequence
  Synthetic oligonucleotide
gaggagctcaccttcc

SEQ ID NO: 1795 - DNA, 16 bp, Artificial sequence
  Synthetic oligonucleotide
cccgttcctccccaat

SEQ ID NO: 1796 - DNA, 16 bp, Artificial sequence
  Synthetic oligonucleotide
cggtagctgggtacat

SEQ ID NO: 1797 - DNA, 16 bp, Artificial sequence
  Synthetic oligonucleotide
ctgcccatgcattaag

SEQ ID NO: 1798 - DNA, 16 bp, Artificial sequence
  Synthetic oligonucleotide
gacagatggcgggaga

SEQ ID NO: 1799 - DNA, 16 bp, Artificial sequence
  Synthetic oligonucleotide
tacaaagctctaggct

SEQ ID NO: 1800 - DNA, 16 bp, Artificial sequence
  Synthetic oligonucleotide
ttaagtgctcagcttg

SEQ ID NO: 1801 - DNA, 16 bp, Artificial sequence
  Synthetic oligonucleotide
cagctaaactacggtt

SEQ ID NO: 1802 - DNA, 16 bp, Artificial sequence
  Synthetic oligonucleotide
tgaggacagtcttgtc

SEQ ID NO: 1803 - DNA, 16 bp, Artificial sequence
  Synthetic oligonucleotide
aaaatgcacgccccct

SEQ ID NO: 1804 - DNA, 16 bp, Artificial sequence
  Synthetic oligonucleotide
gtaatcacaagatgca

SEQ ID NO: 1805 - DNA, 16 bp, Artificial sequence
  Synthetic oligonucleotide
ataaagagctgtggca

SEQ ID NO: 1806 - DNA, 16 bp, Artificial sequence
  Synthetic oligonucleotide
ccaacataggtgaaca

SEQ ID NO: 1807 - DNA, 16 bp, Artificial sequence
  Synthetic oligonucleotide
ttaagtgcctggctaa

SEQ ID NO: 1808 - DNA, 16 bp, Artificial sequence
  Synthetic oligonucleotide
taccctaaaatgccca

SEQ ID NO: 1809 - DNA, 16 bp, Artificial sequence
  Synthetic oligonucleotide
tcaaactggaggacca

SEQ ID NO: 1810 - DNA, 16 bp, Artificial sequence
  Synthetic oligonucleotide
ggctggttcaactgat

SEQ ID NO: 1811 - DNA, 16 bp, Artificial sequence
  Synthetic oligonucleotide
agatagggatacatag

SEQ ID NO: 1812 - DNA, 16 bp, Artificial sequence
  Synthetic oligonucleotide
gcccttctacactgag

SEQ ID NO: 1813 - DNA, 16 bp, Artificial sequence
  Synthetic oligonucleotide
ctcacctagcccagct

SEQ ID NO: 1814 - DNA, 16 bp, Artificial sequence
  Synthetic oligonucleotide
cttcgccaatacagag

SEQ ID NO: 1815 - DNA, 16 bp, Artificial sequence
  Synthetic oligonucleotide
ctcagtatgtgtaggc

SEQ ID NO: 1816 - DNA, 16 bp, Artificial sequence
  Synthetic oligonucleotide
caggtttgaagctctg

SEQ ID NO: 1817 - DNA, 16 bp, Artificial sequence
  Synthetic oligonucleotide
aagagggcagataccc

SEQ ID NO: 1818 - DNA, 16 bp, Artificial sequence
  Synthetic oligonucleotide
cagcccccgacttgcc

SEQ ID NO: 1819 - DNA, 16 bp, Artificial sequence
  Synthetic oligonucleotide
tcagcaaagcatagat

SEQ ID NO: 1820 - DNA, 16 bp, Artificial sequence
  Synthetic oligonucleotide
ctaataccgatttcgg

SEQ ID NO: 1821 - DNA, 16 bp, Artificial sequence
  Synthetic oligonucleotide
gtattaagttcttagt

SEQ ID NO: 1822 - DNA, 16 bp, Artificial sequence
  Synthetic oligonucleotide
atagtgacttgagaac

SEQ ID NO: 1823 - DNA, 16 bp, Artificial sequence
  Synthetic oligonucleotide
caccttgaaagccctc

SEQ ID NO: 1824 - DNA, 16 bp, Artificial sequence
  Synthetic oligonucleotide
tgcacggatccagcat

SEQ ID NO: 1825 - DNA, 16 bp, Artificial sequence
  Synthetic oligonucleotide
tgtagatagacatgaa

SEQ ID NO: 1826 - DNA, 16 bp, Artificial sequence
  Synthetic oligonucleotide
gatcaggagcagtgct

SEQ ID NO: 1827 - DNA, 16 bp, Artificial sequence
  Synthetic oligonucleotide
taggcatggactcaaa

SEQ ID NO: 1828 - DNA, 16 bp, Artificial sequence
  Synthetic oligonucleotide
ctatgagggcaatggt

SEQ ID NO: 1829 - DNA, 16 bp, Artificial sequence
  Synthetic oligonucleotide
gatactcgaccacctg

SEQ ID NO: 1830 - DNA, 16 bp, Artificial sequence
  Synthetic oligonucleotide
cataagtcacagactt

SEQ ID NO: 1831 - DNA, 16 bp, Artificial sequence
  Synthetic oligonucleotide
tatgatcatccccctt

SEQ ID NO: 1832 - DNA, 16 bp, Artificial sequence
  Synthetic oligonucleotide
ccgtccatacctggtg

SEQ ID NO: 1833 - DNA, 16 bp, Artificial sequence
  Synthetic oligonucleotide
gacctgacacctttga

SEQ ID NO: 1834 - DNA, 16 bp, Artificial sequence
  Synthetic oligonucleotide
cattcgcaggtgctga

SEQ ID NO: 1835 - DNA, 16 bp, Artificial sequence
  Synthetic oligonucleotide
cacttgaggaagtcct

SEQ ID NO: 1836 - DNA, 16 bp, Artificial sequence
  Synthetic oligonucleotide
attatacatacgagaa

SEQ ID NO: 1837 - DNA, 16 bp, Artificial sequence
  Synthetic oligonucleotide
gagctagaactttggg

SEQ ID NO: 1838 - DNA, 16 bp, Artificial sequence
  Synthetic oligonucleotide
ccttaacacatgcccc

SEQ ID NO: 1839 - DNA, 16 bp, Artificial sequence
  Synthetic oligonucleotide
acagaaggttttgcgc

SEQ ID NO: 1840 - DNA, 16 bp, Artificial sequence
  Synthetic oligonucleotide
ggttaggttccctgca

SEQ ID NO: 1841 - DNA, 16 bp, Artificial sequence
  Synthetic oligonucleotide
ttacatagctggtcct

SEQ ID NO: 1842 - DNA, 16 bp, Artificial sequence
  Synthetic oligonucleotide
tgaatagggctcttta

SEQ ID NO: 1843 - DNA, 16 bp, Artificial sequence
  Synthetic oligonucleotide
aaggaccattcttacc

SEQ ID NO: 1844 - DNA, 16 bp, Artificial sequence
  Synthetic oligonucleotide
tcccgaaaggaagctt

SEQ ID NO: 1845 - DNA, 16 bp, Artificial sequence
  Synthetic oligonucleotide
gggtccctcccttctg

SEQ ID NO: 1846 - DNA, 16 bp, Artificial sequence
  Synthetic oligonucleotide
tcgggcgaatccaccc

SEQ ID NO: 1847 - DNA, 16 bp, Artificial sequence
  Synthetic oligonucleotide
gcacaccaaaggatgc

SEQ ID NO: 1848 - DNA, 16 bp, Artificial sequence
  Synthetic oligonucleotide
agcacctgacataagt

SEQ ID NO: 1849 - DNA, 16 bp, Artificial sequence
  Synthetic oligonucleotide
ccctacaaggtgagtc

SEQ ID NO: 1850 - DNA, 16 bp, Artificial sequence
  Synthetic oligonucleotide
ctgcttacccagcgga

SEQ ID NO: 1851 - DNA, 16 bp, Artificial sequence
  Synthetic oligonucleotide
ggtttagggtcagaat

SEQ ID NO: 1852 - DNA, 16 bp, Artificial sequence
  Synthetic oligonucleotide
tggcataaaggctggg

SEQ ID NO: 1853 - DNA, 16 bp, Artificial sequence
  Synthetic oligonucleotide
gtgaggttcaggtttg

SEQ ID NO: 1854 - DNA, 16 bp, Artificial sequence
  Synthetic oligonucleotide
ggatgaggttagttgt

SEQ ID NO: 1855 - DNA, 16 bp, Artificial sequence
  Synthetic oligonucleotide
gccaacttaagggtca

SEQ ID NO: 1856 - DNA, 16 bp, Artificial sequence
  Synthetic oligonucleotide
ggacaggactagatgt

SEQ ID NO: 1857 - DNA, 16 bp, Artificial sequence
  Synthetic oligonucleotide
aaaccacgctgtacgg

SEQ ID NO: 1858 - DNA, 16 bp, Artificial sequence
  Synthetic oligonucleotide
ggccgagggcttgcca

SEQ ID NO: 1859 - DNA, 16 bp, Artificial sequence
  Synthetic oligonucleotide
tgggccccgcctcgaa

SEQ ID NO: 1860 - DNA, 16 bp, Artificial sequence
  Synthetic oligonucleotide
accgttgagagctggt

SEQ ID NO: 1861 - DNA, 16 bp, Artificial sequence
  Synthetic oligonucleotide
gatttgggaaggtgca

SEQ ID NO: 1862 - DNA, 16 bp, Artificial sequence
  Synthetic oligonucleotide
gtgcttgaggaagtcc

SEQ ID NO: 1863 - DNA, 16 bp, Artificial sequence
  Synthetic oligonucleotide
cccttgtcggatgatg

SEQ ID NO: 1864 - DNA, 16 bp, Artificial sequence
  Synthetic oligonucleotide
tccatgttgtggagga

SEQ ID NO: 1865 - DNA, 16 bp, Artificial sequence
  Synthetic oligonucleotide
ctcgctctccacccgc

SEQ ID NO: 1866 - DNA, 16 bp, Artificial sequence
  Synthetic oligonucleotide
accagtttggcccctg

SEQ ID NO: 1867 - DNA, 16 bp, Artificial sequence
  Synthetic oligonucleotide
atctgtgcgagcagct

SEQ ID NO: 1868 - DNA, 16 bp, Artificial sequence
  Synthetic oligonucleotide
tgcagctttgaggttg

SEQ ID NO: 1869 - DNA, 16 bp, Artificial sequence
  Synthetic oligonucleotide
aacaggccgtgtgtgt

SEQ ID NO: 1870 - DNA, 16 bp, Artificial sequence
  Synthetic oligonucleotide
atgagtagttcctctg

SEQ ID NO: 1871 - DNA, 16 bp, Artificial sequence
  Synthetic oligonucleotide
agaggagctcaccttc

SEQ ID NO: 1872 - DNA, 16 bp, Artificial sequence
  Synthetic oligonucleotide
tcccgttcctccccaa

SEQ ID NO: 1873 - DNA, 16 bp, Artificial sequence
  Synthetic oligonucleotide
acggtagctgggtaca

SEQ ID NO: 1874 - DNA, 16 bp, Artificial sequence
  Synthetic oligonucleotide
atcaattgatgaattc

SEQ ID NO: 1875 - DNA, 16 bp, Artificial sequence
  Synthetic oligonucleotide
agacagatggcgggag

SEQ ID NO: 1876 - DNA, 16 bp, Artificial sequence
  Synthetic oligonucleotide
gtacaaagctctaggc

SEQ ID NO: 1877 - DNA, 16 bp, Artificial sequence
  Synthetic oligonucleotide
gttaagtgctcagctt

SEQ ID NO: 1878 - DNA, 16 bp, Artificial sequence
  Synthetic oligonucleotide
gtccacacagctaaac

SEQ ID NO: 1879 - DNA, 16 bp, Artificial sequence
  Synthetic oligonucleotide
tgtgaggacagtcttg

SEQ ID NO: 1880 - DNA, 16 bp, Artificial sequence
  Synthetic oligonucleotide
taaaaatgcacgcccc

SEQ ID NO: 1881 - DNA, 16 bp, Artificial sequence
  Synthetic oligonucleotide
agtaatcacaagatgc

SEQ ID NO: 1882 - DNA, 16 bp, Artificial sequence
  Synthetic oligonucleotide
aataaagagctgtggc

SEQ ID NO: 1883 - DNA, 16 bp, Artificial sequence
  Synthetic oligonucleotide
gccaacataggtgaac

SEQ ID NO: 1884 - DNA, 16 bp, Artificial sequence
  Synthetic oligonucleotide
gttaagtgcctggcta

SEQ ID NO: 1885 - DNA, 16 bp, Artificial sequence
  Synthetic oligonucleotide
tataccctaaaatgcc

SEQ ID NO: 1886 - DNA, 16 bp, Artificial sequence
  Synthetic oligonucleotide
ttcaaactggaggacc

SEQ ID NO: 1887 - DNA, 16 bp, Artificial sequence
  Synthetic oligonucleotide
ctggctggttcaactg

SEQ ID NO: 1888 - DNA, 16 bp, Artificial sequence
  Synthetic oligonucleotide
gagatagggatacata

SEQ ID NO: 1889 - DNA, 16 bp, Artificial sequence
  Synthetic oligonucleotide
aatttgcccttctaca

SEQ ID NO: 1890 - DNA, 16 bp, Artificial sequence
  Synthetic oligonucleotide
acctatggagtccggg

SEQ ID NO: 1891 - DNA, 16 bp, Artificial sequence
  Synthetic oligonucleotide
ccttcgccaatacaga

SEQ ID NO: 1892 - DNA, 16 bp, Artificial sequence
  Synthetic oligonucleotide
tctcagtatgtgtagg

SEQ ID NO: 1893 - DNA, 16 bp, Artificial sequence
  Synthetic oligonucleotide
ccaggtttgaagctct

SEQ ID NO: 1894 - DNA, 16 bp, Artificial sequence
  Synthetic oligonucleotide
gaagagggcagatacc

SEQ ID NO: 1895 - DNA, 16 bp, Artificial sequence
  Synthetic oligonucleotide
tcacagcccccgactt

SEQ ID NO: 1896 - DNA, 16 bp, Artificial sequence
  Synthetic oligonucleotide
cctgactcagcaaagc

SEQ ID NO: 1897 - DNA, 16 bp, Artificial sequence
  Synthetic oligonucleotide
actaataccgatttcg

SEQ ID NO: 1898 - DNA, 16 bp, Artificial sequence
  Synthetic oligonucleotide
caggtattaagttctt

SEQ ID NO: 1899 - DNA, 16 bp, Artificial sequence
  Synthetic oligonucleotide
catagtgacttgagaa

SEQ ID NO: 1900 - DNA, 16 bp, Artificial sequence
  Synthetic oligonucleotide
tcaccttgaaagccct

SEQ ID NO: 1901 - DNA, 16 bp, Artificial sequence
  Synthetic oligonucleotide
atgcacggatccagca

SEQ ID NO: 1902 - DNA, 16 bp, Artificial sequence
  Synthetic oligonucleotide
gcaaaagtgcaggtgt

SEQ ID NO: 1903 - DNA, 16 bp, Artificial sequence
  Synthetic oligonucleotide
ctggatcaggagcagt

SEQ ID NO: 1904 - DNA, 16 bp, Artificial sequence
  Synthetic oligonucleotide
gactaggcatggactc

SEQ ID NO: 1905 - DNA, 16 bp, Artificial sequence
  Synthetic oligonucleotide
tctatgagggcaatgg

SEQ ID NO: 1906 - DNA, 16 bp, Artificial sequence
  Synthetic oligonucleotide
agatactcgaccacct

SEQ ID NO: 1907 - DNA, 16 bp, Artificial sequence
  Synthetic oligonucleotide
gcataagtcacagact

SEQ ID NO: 1908 - DNA, 16 bp, Artificial sequence
  Synthetic oligonucleotide
gctatgatcatccccc

SEQ ID NO: 1909 - DNA, 16 bp, Artificial sequence
  Synthetic oligonucleotide
caccgtccatacctgg

SEQ ID NO: 1910 - DNA, 16 bp, Artificial sequence
  Synthetic oligonucleotide
agacctgacacctttg

SEQ ID NO: 1911 - DNA, 16 bp, Artificial sequence
  Synthetic oligonucleotide
ccattcgcaggtgctg

SEQ ID NO: 1912 - DNA, 16 bp, Artificial sequence
  Synthetic oligonucleotide
tcacttgaggaagtcc

SEQ ID NO: 1913 - DNA, 16 bp, Artificial sequence
  Synthetic oligonucleotide
ttattatacatacgag

SEQ ID NO: 1914 - DNA, 16 bp, Artificial sequence
  Synthetic oligonucleotide
ggagctagaactttgg

SEQ ID NO: 1915 - DNA, 16 bp, Artificial sequence
  Synthetic oligonucleotide
gctcaatgctctgaat

SEQ ID NO: 1916 - DNA, 16 bp, Artificial sequence
  Synthetic oligonucleotide
gacagaaggttttgcg

SEQ ID NO: 1917 - DNA, 16 bp, Artificial sequence
  Synthetic oligonucleotide
gaggttaggttccctg

SEQ ID NO: 1918 - DNA, 16 bp, Artificial sequence
  Synthetic oligonucleotide
gttacatagctggtcc

SEQ ID NO: 1919 - DNA, 16 bp, Artificial sequence
  Synthetic oligonucleotide
gttgaatagggctctt

SEQ ID NO: 1920 - DNA, 16 bp, Artificial sequence
  Synthetic oligonucleotide
caaggaccattcttac

SEQ ID NO: 1921 - DNA, 16 bp, Artificial sequence
  Synthetic oligonucleotide
atcccgaaaggaagct

SEQ ID NO: 1922 - DNA, 16 bp, Artificial sequence
  Synthetic oligonucleotide
tagcagggtccctccc

SEQ ID NO: 1923 - DNA, 16 bp, Artificial sequence
  Synthetic oligonucleotide
ctcgggcgaatccacc

SEQ ID NO: 1924 - DNA, 16 bp, Artificial sequence
  Synthetic oligonucleotide
agtaacttgcacacca

SEQ ID NO: 1925 - DNA, 16 bp, Artificial sequence
  Synthetic oligonucleotide
gagcacctgacataag

SEQ ID NO: 1926 - DNA, 16 bp, Artificial sequence
  Synthetic oligonucleotide
cccctacaaggtgagt

SEQ ID NO: 1927 - DNA, 16 bp, Artificial sequence
  Synthetic oligonucleotide
cctgcttacccagcgg

SEQ ID NO: 1928 - DNA, 16 bp, Artificial sequence
  Synthetic oligonucleotide
taggtttagggtcaga

SEQ ID NO: 1929 - DNA, 16 bp, Artificial sequence
  Synthetic oligonucleotide
ttggcataaaggctgg

SEQ ID NO: 1930 - DNA, 16 bp, Artificial sequence
  Synthetic oligonucleotide
ggtgaggttcaggttt

SEQ ID NO: 1931 - DNA, 16 bp, Artificial sequence
  Synthetic oligonucleotide
aggatgaggttagttg

SEQ ID NO: 1932 - DNA, 16 bp, Artificial sequence
  Synthetic oligonucleotide
ggccaacttaagggtc

SEQ ID NO: 1933 - DNA, 16 bp, Artificial sequence
  Synthetic oligonucleotide
agggacaggactagat

SEQ ID NO: 1934 - DNA, 16 bp, Artificial sequence
  Synthetic oligonucleotide
aaaaccacgctgtacg

SEQ ID NO: 1935 - DNA, 16 bp, Artificial sequence
  Synthetic oligonucleotide
tgggcgaggctcctgg

SEQ ID NO: 1936 - DNA, 16 bp, Artificial sequence
  Synthetic oligonucleotide
aggcatgggccccgcc

SEQ ID NO: 1937 - DNA, 16 bp, Artificial sequence
  Synthetic oligonucleotide
ccaccgttgagagctg

SEQ ID NO: 1938 - DNA, 16 bp, Artificial sequence
  Synthetic oligonucleotide
gtgcactgggatttgg

SEQ ID NO: 1939 - DNA, 16 bp, Artificial sequence
  Synthetic oligonucleotide
cagtgcttgaggaagt

SEQ ID NO: 1940 - DNA, 16 bp, Artificial sequence
  Synthetic oligonucleotide
gcccttgtcggatgat

SEQ ID NO: 1941 - DNA, 16 bp, Artificial sequence
  Synthetic oligonucleotide
tagtccatgttgtgga

SEQ ID NO: 1942 - DNA, 16 bp, Artificial sequence
  Synthetic oligonucleotide
tctcgctctccacccg

SEQ ID NO: 1943 - DNA, 16 bp, Artificial sequence
  Synthetic oligonucleotide
tcccaccagtttggcc

SEQ ID NO: 1944 - DNA, 16 bp, Artificial sequence
  Synthetic oligonucleotide
aatctgtgcgagcagc

SEQ ID NO: 1945 - DNA, 16 bp, Artificial sequence
  Synthetic oligonucleotide
gatgcagctttgaggt

SEQ ID NO: 1946 - DNA, 16 bp, Artificial sequence
  Synthetic oligonucleotide
tgaattctaacaggcc

SEQ ID NO: 1947 - DNA, 16 bp, Artificial sequence
  Synthetic oligonucleotide
gccttggatcccaaat

SEQ ID NO: 1948 - DNA, 16 bp, Artificial sequence
  Synthetic oligonucleotide
cagaggagctcacctt

SEQ ID NO: 1949 - DNA, 16 bp, Artificial sequence
  Synthetic oligonucleotide
catcccgttcctcccc

SEQ ID NO: 1950 - DNA, 16 bp, Artificial sequence
  Synthetic oligonucleotide
cacggtagctgggtac

SEQ ID NO: 1951 - DNA, 16 bp, Artificial sequence
  Synthetic oligonucleotide
cgtatcaattgatgaa

SEQ ID NO: 1952 - DNA, 16 bp, Artificial sequence
  Synthetic oligonucleotide
acagacagatggcggg

SEQ ID NO: 1953 - DNA, 16 bp, Artificial sequence
  Synthetic oligonucleotide
tactattattaaacgc

SEQ ID NO: 1954 - DNA, 16 bp, Artificial sequence
  Synthetic oligonucleotide
agttaagtgctcagct

SEQ ID NO: 1955 - DNA, 16 bp, Artificial sequence
  Synthetic oligonucleotide
aggtccacacagctaa

SEQ ID NO: 1956 - DNA, 16 bp, Artificial sequence
  Synthetic oligonucleotide
atgtgaggacagtctt

SEQ ID NO: 1957 - DNA, 16 bp, Artificial sequence
  Synthetic oligonucleotide
ttaaaaatgcacgccc

SEQ ID NO: 1958 - DNA, 16 bp, Artificial sequence
  Synthetic oligonucleotide
gccaatgaatagtaaa

SEQ ID NO: 1959 - DNA, 16 bp, Artificial sequence
  Synthetic oligonucleotide
tccaaataaagagctg

SEQ ID NO: 1960 - DNA, 16 bp, Artificial sequence
  Synthetic oligonucleotide
agccaacataggtgaa

SEQ ID NO: 1961 - DNA, 16 bp, Artificial sequence
  Synthetic oligonucleotide
cagtacatatgaggaa

SEQ ID NO: 1962 - DNA, 16 bp, Artificial sequence
  Synthetic oligonucleotide
catataccctaaaatg

SEQ ID NO: 1963 - DNA, 16 bp, Artificial sequence
  Synthetic oligonucleotide
tttcaaactggaggac

SEQ ID NO: 1964 - DNA, 16 bp, Artificial sequence
  Synthetic oligonucleotide
tctctggctggttcaa

SEQ ID NO: 1965 - DNA, 16 bp, Artificial sequence
  Synthetic oligonucleotide
agagatagggatacat

SEQ ID NO: 1966 - DNA, 16 bp, Artificial sequence
  Synthetic oligonucleotide
caatttgcccttctac

SEQ ID NO: 1967 - DNA, 16 bp, Artificial sequence
  Synthetic oligonucleotide
gacctatggagtccgg

SEQ ID NO: 1968 - DNA, 16 bp, Artificial sequence
  Synthetic oligonucleotide
gccttcgccaatacag

SEQ ID NO: 1969 - DNA, 16 bp, Artificial sequence
  Synthetic oligonucleotide
tcccaaagtctcagta

SEQ ID NO: 1970 - DNA, 16 bp, Artificial sequence
  Synthetic oligonucleotide
cccaggtttgaagctc

SEQ ID NO: 1971 - DNA, 16 bp, Artificial sequence
  Synthetic oligonucleotide
agaagagggcagatac

SEQ ID NO: 1972 - DNA, 16 bp, Artificial sequence
  Synthetic oligonucleotide
tgtcacagcccccgac

SEQ ID NO: 1973 - DNA, 16 bp, Artificial sequence
  Synthetic oligonucleotide
gtgggatggcctgact

SEQ ID NO: 1974 - DNA, 16 bp, Artificial sequence
  Synthetic oligonucleotide
aactaataccgatttc

SEQ ID NO: 1975 - DNA, 16 bp, Artificial sequence
  Synthetic oligonucleotide
ccaggtattaagttct

SEQ ID NO: 1976 - DNA, 16 bp, Artificial sequence
  Synthetic oligonucleotide
ccatagtgacttgaga

SEQ ID NO: 1977 - DNA, 16 bp, Artificial sequence
  Synthetic oligonucleotide
ctcaccttgaaagccc

SEQ ID NO: 1978 - DNA, 16 bp, Artificial sequence
  Synthetic oligonucleotide
atcatgcacggatcca

SEQ ID NO: 1979 - DNA, 16 bp, Artificial sequence
  Synthetic oligonucleotide
tgcaaaagtgcaggtg

SEQ ID NO: 1980 - DNA, 16 bp, Artificial sequence
  Synthetic oligonucleotide
tctgaagctggatcag

SEQ ID NO: 1981 - DNA, 16 bp, Artificial sequence
  Synthetic oligonucleotide
tgactaggcatggact

SEQ ID NO: 1982 - DNA, 16 bp, Artificial sequence
  Synthetic oligonucleotide
cctctatgagggcaat

SEQ ID NO: 1983 - DNA, 16 bp, Artificial sequence
  Synthetic oligonucleotide
atgagatactcgacca

SEQ ID NO: 1984 - DNA, 16 bp, Artificial sequence
  Synthetic oligonucleotide
ctgcataagtcacaga

SEQ ID NO: 1985 - DNA, 16 bp, Artificial sequence
  Synthetic oligonucleotide
atgctatgatcatccc

SEQ ID NO: 1986 - DNA, 16 bp, Artificial sequence
  Synthetic oligonucleotide
attcaccgtccatacc

SEQ ID NO: 1987 - DNA, 16 bp, Artificial sequence
  Synthetic oligonucleotide
gagacctgacaccttt

SEQ ID NO: 1988 - DNA, 16 bp, Artificial sequence
  Synthetic oligonucleotide
gccattcgcaggtgct

SEQ ID NO: 1989 - DNA, 16 bp, Artificial sequence
  Synthetic oligonucleotide
ctcacttgaggaagtc

SEQ ID NO: 1990 - DNA, 16 bp, Artificial sequence
  Synthetic oligonucleotide
aataacagcacaaacg

SEQ ID NO: 1991 - DNA, 16 bp, Artificial sequence
  Synthetic oligonucleotide
aggagctagaactttg

SEQ ID NO: 1992 - DNA, 16 bp, Artificial sequence
  Synthetic oligonucleotide
ccacgacaggcctggt

SEQ ID NO: 1993 - DNA, 16 bp, Artificial sequence
  Synthetic oligonucleotide
gtggacagaaggtttt

SEQ ID NO: 1994 - DNA, 16 bp, Artificial sequence
  Synthetic oligonucleotide
tgaggttaggttccct

SEQ ID NO: 1995 - DNA, 16 bp, Artificial sequence
  Synthetic oligonucleotide
gcaggttacatagctg

SEQ ID NO: 1996 - DNA, 16 bp, Artificial sequence
  Synthetic oligonucleotide
cgtatgtggccactga

SEQ ID NO: 1997 - DNA, 16 bp, Artificial sequence
  Synthetic oligonucleotide
gcaaggaccattctta

SEQ ID NO: 1998 - DNA, 16 bp, Artificial sequence
  Synthetic oligonucleotide
cacggacatcccgaaa

SEQ ID NO: 1999 - DNA, 16 bp, Artificial sequence
  Synthetic oligonucleotide
ttagcagggtccctcc

SEQ ID NO: 2000 - DNA, 16 bp, Artificial sequence
  Synthetic oligonucleotide
gctcgggcgaatccac

SEQ ID NO: 2001 - DNA, 16 bp, Artificial sequence
  Synthetic oligonucleotide
ggagtaacttgcacac

SEQ ID NO: 2002 - DNA, 16 bp, Artificial sequence
  Synthetic oligonucleotide
gtactgtttgctgagc

SEQ ID NO: 2003 - DNA, 16 bp, Artificial sequence
  Synthetic oligonucleotide
agctagctccctgtcc

SEQ ID NO: 2004 - DNA, 16 bp, Artificial sequence
  Synthetic oligonucleotide
ccctgcttacccagcg

SEQ ID NO: 2005 - DNA, 16 bp, Artificial sequence
  Synthetic oligonucleotide
gaggtggacatctgga

SEQ ID NO: 2006 - DNA, 16 bp, Artificial sequence
  Synthetic oligonucleotide
ttgggttggcataaag

SEQ ID NO: 2007 - DNA, 16 bp, Artificial sequence
  Synthetic oligonucleotide
ctggtatcatgtaggg

SEQ ID NO: 2008 - DNA, 16 bp, Artificial sequence
  Synthetic oligonucleotide
aaggatgaggttagtt

SEQ ID NO: 2009 - DNA, 16 bp, Artificial sequence
  Synthetic oligonucleotide
aggccaacttaagggt

SEQ ID NO: 2010 - DNA, 16 bp, Artificial sequence
  Synthetic oligonucleotide
atcagggacaggacta

SEQ ID NO: 2011 - DNA, 16 bp, Artificial sequence
  Synthetic oligonucleotide
ccgagaagaaaaacca

SEQ ID NO: 2012 - DNA, 16 bp, Artificial sequence
  Synthetic oligonucleotide
ctgggcgaggctcctg

SEQ ID NO: 2013 - DNA, 16 bp, Artificial sequence
  Synthetic oligonucleotide
gaggcatgggccccgc

SEQ ID NO: 2014 - DNA, 16 bp, Artificial sequence
  Synthetic oligonucleotide
tccaccgttgagagct

SEQ ID NO: 2015 - DNA, 16 bp, Artificial sequence
  Synthetic oligonucleotide
cttcctgggtgcactg

SEQ ID NO: 2016 - DNA, 16 bp, Artificial sequence
  Synthetic oligonucleotide
cgcctggcagtgcttg

SEQ ID NO: 2017 - DNA, 16 bp, Artificial sequence
  Synthetic oligonucleotide
gagcccttgtcggatg

SEQ ID NO: 2018 - DNA, 16 bp, Artificial sequence
  Synthetic oligonucleotide
agtagtccatgttgtg

SEQ ID NO: 2019 - DNA, 16 bp, Artificial sequence
  Synthetic oligonucleotide
cttctcgctctccacc

SEQ ID NO: 2020 - DNA, 16 bp, Artificial sequence
  Synthetic oligonucleotide
gcctcccaccagtttg

SEQ ID NO: 2021 - DNA, 16 bp, Artificial sequence
  Synthetic oligonucleotide
taatctgtgcgagcag

SEQ ID NO: 2022 - DNA, 16 bp, Artificial sequence
  Synthetic oligonucleotide
tgatgcagctttgagg

SEQ ID NO: 2023 - DNA, 16 bp, Artificial sequence
  Synthetic oligonucleotide
tgagatacacaggtga

SEQ ID NO: 2024 - DNA, 16 bp, Artificial sequence
  Synthetic oligonucleotide
ggccttggatcccaaa

SEQ ID NO: 2025 - DNA, 16 bp, Artificial sequence
  Synthetic oligonucleotide
tcagaggagctcacct

SEQ ID NO: 2026 - DNA, 16 bp, Artificial sequence
  Synthetic oligonucleotide
acatcccgttcctccc

SEQ ID NO: 2027 - DNA, 16 bp, Artificial sequence
  Synthetic oligonucleotide
tcacggtagctgggta

SEQ ID NO: 2028 - DNA, 16 bp, Artificial sequence
  Synthetic oligonucleotide
atcctatccatctacg

SEQ ID NO: 2029 - DNA, 16 bp, Artificial sequence
  Synthetic oligonucleotide
agtgtagcgacagaca

SEQ ID NO: 2030 - DNA, 16 bp, Artificial sequence
  Synthetic oligonucleotide
ttactattattaaacg

SEQ ID NO: 2031 - DNA, 16 bp, Artificial sequence
  Synthetic oligonucleotide
cagttaagtgctcagc

SEQ ID NO: 2032 - DNA, 16 bp, Artificial sequence
  Synthetic oligonucleotide
gggtaggtccacacag

SEQ ID NO: 2033 - DNA, 16 bp, Artificial sequence
  Synthetic oligonucleotide
gatgtgaggacagtct

SEQ ID NO: 2034 - DNA, 16 bp, Artificial sequence
  Synthetic oligonucleotide
tttaaaaatgcacgcc

SEQ ID NO: 2035 - DNA, 16 bp, Artificial sequence
  Synthetic oligonucleotide
ggccaatgaatagtaa

SEQ ID NO: 2036 - DNA, 16 bp, Artificial sequence
  Synthetic oligonucleotide
ggttaataaccattcc

SEQ ID NO: 2037 - DNA, 16 bp, Artificial sequence
  Synthetic oligonucleotide
aagccaacataggtga

SEQ ID NO: 2038 - DNA, 16 bp, Artificial sequence
  Synthetic oligonucleotide
tataaccattgcagta

SEQ ID NO: 2039 - DNA, 16 bp, Artificial sequence
  Synthetic oligonucleotide
catcatcatataccct

SEQ ID NO: 2040 - DNA, 16 bp, Artificial sequence
  Synthetic oligonucleotide
ggcatttcaaactgga

SEQ ID NO: 2041 - DNA, 16 bp, Artificial sequence
  Synthetic oligonucleotide
acatttgctggtctct

SEQ ID NO: 2042 - DNA, 16 bp, Artificial sequence
  Synthetic oligonucleotide
ctgagagatagggata

SEQ ID NO: 2043 - DNA, 16 bp, Artificial sequence
  Synthetic oligonucleotide
cctgagatctctggtc

SEQ ID NO: 2044 - DNA, 16 bp, Artificial sequence
  Synthetic oligonucleotide
cctgacctatggagtc

SEQ ID NO: 2045 - DNA, 16 bp, Artificial sequence
  Synthetic oligonucleotide
cgccagagatggcaac

SEQ ID NO: 2046 - DNA, 16 bp, Artificial sequence
  Synthetic oligonucleotide
tctacggtcccaaagt

SEQ ID NO: 2047 - DNA, 16 bp, Artificial sequence
  Synthetic oligonucleotide
acccaggtttgaagct

SEQ ID NO: 2048 - DNA, 16 bp, Artificial sequence
  Synthetic oligonucleotide
accacggaggaagaga

SEQ ID NO: 2049 - DNA, 16 bp, Artificial sequence
  Synthetic oligonucleotide
cctgttgtcacagccc

SEQ ID NO: 2050 - DNA, 16 bp, Artificial sequence
  Synthetic oligonucleotide
atgtgggatggcctga

SEQ ID NO: 2051 - DNA, 16 bp, Artificial sequence
  Synthetic oligonucleotide
caaactaataccgatt

SEQ ID NO: 2052 - DNA, 16 bp, Artificial sequence
  Synthetic oligonucleotide
tccaggtattaagttc

SEQ ID NO: 2053 - DNA, 16 bp, Artificial sequence
  Synthetic oligonucleotide
cccatagtgacttgag

SEQ ID NO: 2054 - DNA, 16 bp, Artificial sequence
  Synthetic oligonucleotide
tattgtcctcaccttg

SEQ ID NO: 2055 - DNA, 16 bp, Artificial sequence
  Synthetic oligonucleotide
gatcatgcacggatcc

SEQ ID NO: 2056 - DNA, 16 bp, Artificial sequence
  Synthetic oligonucleotide
gtgcaaaagtgcaggt

SEQ ID NO: 2057 - DNA, 16 bp, Artificial sequence
  Synthetic oligonucleotide
atctgaagctggatca

SEQ ID NO: 2058 - DNA, 16 bp, Artificial sequence
  Synthetic oligonucleotide
agtgactaggcatgga

SEQ ID NO: 2059 - DNA, 16 bp, Artificial sequence
  Synthetic oligonucleotide
tcctctatgagggcaa

SEQ ID NO: 2060 - DNA, 16 bp, Artificial sequence
  Synthetic oligonucleotide
tatgagatactcgacc

SEQ ID NO: 2061 - DNA, 16 bp, Artificial sequence
  Synthetic oligonucleotide
caacatctgcataagt

SEQ ID NO: 2062 - DNA, 16 bp, Artificial sequence
  Synthetic oligonucleotide
gatgctatgatcatcc

SEQ ID NO: 2063 - DNA, 16 bp, Artificial sequence
  Synthetic oligonucleotide
ccattcaccgtccata

SEQ ID NO: 2064 - DNA, 16 bp, Artificial sequence
  Synthetic oligonucleotide
tgagacctgacacctt

SEQ ID NO: 2065 - DNA, 16 bp, Artificial sequence
  Synthetic oligonucleotide
ggccattcgcaggtgc

SEQ ID NO: 2066 - DNA, 16 bp, Artificial sequence
  Synthetic oligonucleotide
actcacttgaggaagt

SEQ ID NO: 2067 - DNA, 16 bp, Artificial sequence
  Synthetic oligonucleotide
gatcaagacacttaac

SEQ ID NO: 2068 - DNA, 16 bp, Artificial sequence
  Synthetic oligonucleotide
gaggagctagaacttt

SEQ ID NO: 2069 - DNA, 16 bp, Artificial sequence
  Synthetic oligonucleotide
accacgacaggcctgg

SEQ ID NO: 2070 - DNA, 16 bp, Artificial sequence
  Synthetic oligonucleotide
atggtggacagaaggt

SEQ ID NO: 2071 - DNA, 16 bp, Artificial sequence
  Synthetic oligonucleotide
gtgaggttaggttccc

SEQ ID NO: 2072 - DNA, 16 bp, Artificial sequence
  Synthetic oligonucleotide
ctgcaggttacatagc

SEQ ID NO: 2073 - DNA, 16 bp, Artificial sequence
  Synthetic oligonucleotide
ttagagcacaggtgcg

SEQ ID NO: 2074 - DNA, 16 bp, Artificial sequence
  Synthetic oligonucleotide
tgcaaggaccattctt

SEQ ID NO: 2075 - DNA, 16 bp, Artificial sequence
  Synthetic oligonucleotide
gccacggacatcccga

SEQ ID NO: 2076 - DNA, 16 bp, Artificial sequence
  Synthetic oligonucleotide
cttagcagggtccctc

SEQ ID NO: 2077 - DNA, 16 bp, Artificial sequence
  Synthetic oligonucleotide
agctcgggcgaatcca

SEQ ID NO: 2078 - DNA, 16 bp, Artificial sequence
  Synthetic oligonucleotide
cggagtaacttgcaca

SEQ ID NO: 2079 - DNA, 16 bp, Artificial sequence
  Synthetic oligonucleotide
acaggtactgtttgct

SEQ ID NO: 2080 - DNA, 16 bp, Artificial sequence
  Synthetic oligonucleotide
tagctagctccctgtc

SEQ ID NO: 2081 - DNA, 16 bp, Artificial sequence
  Synthetic oligonucleotide
ttgggaggcaggtccc

SEQ ID NO: 2082 - DNA, 16 bp, Artificial sequence
  Synthetic oligonucleotide
tgaggtggacatctgg

SEQ ID NO: 2083 - DNA, 16 bp, Artificial sequence
  Synthetic oligonucleotide
gttgggttggcataaa

SEQ ID NO: 2084 - DNA, 16 bp, Artificial sequence
  Synthetic oligonucleotide
tctggtatcatgtagg

SEQ ID NO: 2085 - DNA, 16 bp, Artificial sequence
  Synthetic oligonucleotide
caaggatgaggttagt

SEQ ID NO: 2086 - DNA, 16 bp, Artificial sequence
  Synthetic oligonucleotide
gacatttcagggttgg

SEQ ID NO: 2087 - DNA, 16 bp, Artificial sequence
  Synthetic oligonucleotide
aatcagggacaggact

SEQ ID NO: 2088 - DNA, 16 bp, Artificial sequence
  Synthetic oligonucleotide
ttgcttttataccgag

SEQ ID NO: 2089 - DNA, 16 bp, Artificial sequence
  Synthetic oligonucleotide
gctgggcgaggctcct

SEQ ID NO: 2090 - DNA, 16 bp, Artificial sequence
  Synthetic oligonucleotide
gaggaggcatgggccc

SEQ ID NO: 2091 - DNA, 16 bp, Artificial sequence
  Synthetic oligonucleotide
atccaccgttgagagc

SEQ ID NO: 2092 - DNA, 16 bp, Artificial sequence
  Synthetic oligonucleotide
aaagggtgctgtcctt

SEQ ID NO: 2093 - DNA, 16 bp, Artificial sequence
  Synthetic oligonucleotide
tccgcctggcagtgct

SEQ ID NO: 2094 - DNA, 16 bp, Artificial sequence
  Synthetic oligonucleotide
caggagcccttgtcgg

SEQ ID NO: 2095 - DNA, 16 bp, Artificial sequence
  Synthetic oligonucleotide
aagtagtccatgttgt

SEQ ID NO: 2096 - DNA, 16 bp, Artificial sequence
  Synthetic oligonucleotide
cagcccccttctcgct

SEQ ID NO: 2097 - DNA, 16 bp, Artificial sequence
  Synthetic oligonucleotide
gcctatcatccctgcc

SEQ ID NO: 2098 - DNA, 16 bp, Artificial sequence
  Synthetic oligonucleotide
aagtaatctgtgcgag

SEQ ID NO: 2099 - DNA, 16 bp, Artificial sequence
  Synthetic oligonucleotide
atgatgcagctttgag

SEQ ID NO: 2100 - DNA, 16 bp, Artificial sequence
  Synthetic oligonucleotide
gtgagatacacaggtg

SEQ ID NO: 2101 - DNA, 16 bp, Artificial sequence
  Synthetic oligonucleotide
acggtactgtgggttg

SEQ ID NO: 2102 - DNA, 16 bp, Artificial sequence
  Synthetic oligonucleotide
gccacctcagaggagc

SEQ ID NO: 2103 - DNA, 16 bp, Artificial sequence
  Synthetic oligonucleotide
caacccacatcccgtt

SEQ ID NO: 2104 - DNA, 16 bp, Artificial sequence
  Synthetic oligonucleotide
atcacggtagctgggt

SEQ ID NO: 2105 - DNA, 16 bp, Artificial sequence
  Synthetic oligonucleotide
aatcctatccatctac

SEQ ID NO: 2106 - DNA, 16 bp, Artificial sequence
  Synthetic oligonucleotide
agagagtctgagtgta

SEQ ID NO: 2107 - DNA, 16 bp, Artificial sequence
  Synthetic oligonucleotide
cgacattactattatt

SEQ ID NO: 2108 - DNA, 16 bp, Artificial sequence
  Synthetic oligonucleotide
tcagttaagtgctcag

SEQ ID NO: 2109 - DNA, 16 bp, Artificial sequence
  Synthetic oligonucleotide
gactctggtcacacac

SEQ ID NO: 2110 - DNA, 16 bp, Artificial sequence
  Synthetic oligonucleotide
caaagttcatgctgat

SEQ ID NO: 2111 - DNA, 16 bp, Artificial sequence
  Synthetic oligonucleotide
gggtcataaactttaa

SEQ ID NO: 2112 - DNA, 16 bp, Artificial sequence
  Synthetic oligonucleotide
aagcatgaatggccaa

SEQ ID NO: 2113 - DNA, 16 bp, Artificial sequence
  Synthetic oligonucleotide
aggttaataaccattc

SEQ ID NO: 2114 - DNA, 16 bp, Artificial sequence
  Synthetic oligonucleotide
agaagccaacataggt

SEQ ID NO: 2115 - DNA, 16 bp, Artificial sequence
  Synthetic oligonucleotide
ttataaccattgcagt

SEQ ID NO: 2116 - DNA, 16 bp, Artificial sequence
  Synthetic oligonucleotide
cagtttgaaatgtcac

SEQ ID NO: 2117 - DNA, 16 bp, Artificial sequence
  Synthetic oligonucleotide
gtggcatttcaaactg

SEQ ID NO: 2118 - DNA, 16 bp, Artificial sequence
  Synthetic oligonucleotide
aacatttgctggtctc

SEQ ID NO: 2119 - DNA, 16 bp, Artificial sequence
  Synthetic oligonucleotide
ctggctgagagatagg

SEQ ID NO: 2120 - DNA, 16 bp, Artificial sequence
  Synthetic oligonucleotide
atttcggtgaggccct

SEQ ID NO: 2121 - DNA, 16 bp, Artificial sequence
  Synthetic oligonucleotide
aactaggcctcctgac

SEQ ID NO: 2122 - DNA, 16 bp, Artificial sequence
  Synthetic oligonucleotide
tccgccagagatggca

SEQ ID NO: 2123 - DNA, 16 bp, Artificial sequence
  Synthetic oligonucleotide
ctagaatctcaaaacc

SEQ ID NO: 2124 - DNA, 16 bp, Artificial sequence
  Synthetic oligonucleotide
aggacccaggtttgaa

SEQ ID NO: 2125 - DNA, 16 bp, Artificial sequence
  Synthetic oligonucleotide
caccacggaggaagag

SEQ ID NO: 2126 - DNA, 16 bp, Artificial sequence
  Synthetic oligonucleotide
gccctgttgtcacagc

SEQ ID NO: 2127 - DNA, 16 bp, Artificial sequence
  Synthetic oligonucleotide
catgtgggatggcctg

SEQ ID NO: 2128 - DNA, 16 bp, Artificial sequence
  Synthetic oligonucleotide
acaaactaataccgat

SEQ ID NO: 2129 - DNA, 16 bp, Artificial sequence
  Synthetic oligonucleotide
gaatccaggtattaag

SEQ ID NO: 2130 - DNA, 16 bp, Artificial sequence
  Synthetic oligonucleotide
tcccatagtgacttga

SEQ ID NO: 2131 - DNA, 16 bp, Artificial sequence
  Synthetic oligonucleotide
ctattgtcctcacctt

SEQ ID NO: 2132 - DNA, 16 bp, Artificial sequence
  Synthetic oligonucleotide
tgtgatcatgcacgga

SEQ ID NO: 2133 - DNA, 16 bp, Artificial sequence
  Synthetic oligonucleotide
acattacctgagatgg

SEQ ID NO: 2134 - DNA, 16 bp, Artificial sequence
  Synthetic oligonucleotide
taatctgaagctggat

SEQ ID NO: 2135 - DNA, 16 bp, Artificial sequence
  Synthetic oligonucleotide
ccccagtgactaggca

SEQ ID NO: 2136 - DNA, 16 bp, Artificial sequence
  Synthetic oligonucleotide
atgtgtcctctatgag

SEQ ID NO: 2137 - DNA, 16 bp, Artificial sequence
  Synthetic oligonucleotide
ggcggtatgagatact

SEQ ID NO: 2138 - DNA, 16 bp, Artificial sequence
  Synthetic oligonucleotide
gccctgcaacatctgc

SEQ ID NO: 2139 - DNA, 16 bp, Artificial sequence
  Synthetic oligonucleotide
gtagatgctatgatca

SEQ ID NO: 2140 - DNA, 16 bp, Artificial sequence
  Synthetic oligonucleotide
cccattcaccgtccat

SEQ ID NO: 2141 - DNA, 16 bp, Artificial sequence
  Synthetic oligonucleotide
ctgagacctgacacct

SEQ ID NO: 2142 - DNA, 16 bp, Artificial sequence
  Synthetic oligonucleotide
cggccattcgcaggtg

SEQ ID NO: 2143 - DNA, 16 bp, Artificial sequence
  Synthetic oligonucleotide
ccactcacttgaggaa

SEQ ID NO: 2144 - DNA, 16 bp, Artificial sequence
  Synthetic oligonucleotide
attttgatcaagacac

SEQ ID NO: 2145 - DNA, 16 bp, Artificial sequence
  Synthetic oligonucleotide
tagaggagctagaact

SEQ ID NO: 2146 - DNA, 16 bp, Artificial sequence
  Synthetic oligonucleotide
gattccatgcaggtga

SEQ ID NO: 2147 - DNA, 16 bp, Artificial sequence
  Synthetic oligonucleotide
gcacatggtggacaga

SEQ ID NO: 2148 - DNA, 16 bp, Artificial sequence
  Synthetic oligonucleotide
tgtgaggttaggttcc

SEQ ID NO: 2149 - DNA, 16 bp, Artificial sequence
  Synthetic oligonucleotide
cgccatcttgaaatct

SEQ ID NO: 2150 - DNA, 16 bp, Artificial sequence
  Synthetic oligonucleotide
attagagcacaggtgc

SEQ ID NO: 2151 - DNA, 16 bp, Artificial sequence
  Synthetic oligonucleotide
gtgcaaggaccattct

SEQ ID NO: 2152 - DNA, 16 bp, Artificial sequence
  Synthetic oligonucleotide
actcgagaccatatgg

SEQ ID NO: 2153 - DNA, 16 bp, Artificial sequence
  Synthetic oligonucleotide
acttagcagggtccct

SEQ ID NO: 2154 - DNA, 16 bp, Artificial sequence
  Synthetic oligonucleotide
gagctcgggcgaatcc

SEQ ID NO: 2155 - DNA, 16 bp, Artificial sequence
  Synthetic oligonucleotide
gcggagtaacttgcac

SEQ ID NO: 2156 - DNA, 16 bp, Artificial sequence
  Synthetic oligonucleotide
cacaggtactgtttgc

SEQ ID NO: 2157 - DNA, 16 bp, Artificial sequence
  Synthetic oligonucleotide
ctagctagctccctgt

SEQ ID NO: 2158 - DNA, 16 bp, Artificial sequence
  Synthetic oligonucleotide
gaacccactctgaggg

SEQ ID NO: 2159 - DNA, 16 bp, Artificial sequence
  Synthetic oligonucleotide
ctgaggtggacatctg

SEQ ID NO: 2160 - DNA, 16 bp, Artificial sequence
  Synthetic oligonucleotide
tgtattgacatactgg

SEQ ID NO: 2161 - DNA, 16 bp, Artificial sequence
  Synthetic oligonucleotide
gaatatctggtatcat

SEQ ID NO: 2162 - DNA, 16 bp, Artificial sequence
  Synthetic oligonucleotide
gcaaggatgaggttag

SEQ ID NO: 2163 - DNA, 16 bp, Artificial sequence
  Synthetic oligonucleotide
gtctgggatggagttg

SEQ ID NO: 2164 - DNA, 16 bp, Artificial sequence
  Synthetic oligonucleotide
taatcagggacaggac

SEQ ID NO: 2165 - DNA, 16 bp, Artificial sequence
  Synthetic oligonucleotide
tttgcttttataccga

SEQ ID NO: 2166 - DNA, 16 bp, Artificial sequence
  Synthetic oligonucleotide
agctgggcgaggctcc

SEQ ID NO: 2167 - DNA, 16 bp, Artificial sequence
  Synthetic oligonucleotide
agaggaggcatgggcc

SEQ ID NO: 2168 - DNA, 16 bp, Artificial sequence
  Synthetic oligonucleotide
gcatccaccgttgaga

SEQ ID NO: 2169 - DNA, 16 bp, Artificial sequence
  Synthetic oligonucleotide
gaaagggtgctgtcct

SEQ ID NO: 2170 - DNA, 16 bp, Artificial sequence
  Synthetic oligonucleotide
aagatggtccgcctgg

SEQ ID NO: 2171 - DNA, 16 bp, Artificial sequence
  Synthetic oligonucleotide
agcaggagcccttgtc

SEQ ID NO: 2172 - DNA, 16 bp, Artificial sequence
  Synthetic oligonucleotide
gaagtagtccatgttg

SEQ ID NO: 2173 - DNA, 16 bp, Artificial sequence
  Synthetic oligonucleotide
cggtccacacagcccc

SEQ ID NO: 2174 - DNA, 16 bp, Artificial sequence
  Synthetic oligonucleotide
gggcctatcatccctg

SEQ ID NO: 2175 - DNA, 16 bp, Artificial sequence
  Synthetic oligonucleotide
tgaagtaatctgtgcg

SEQ ID NO: 2176 - DNA, 16 bp, Artificial sequence
  Synthetic oligonucleotide
tgatgatgcagctttg

SEQ ID NO: 2177 - DNA, 16 bp, Artificial sequence
  Synthetic oligonucleotide
cgtgagatacacaggt

SEQ ID NO: 2178 - DNA, 16 bp, Artificial sequence
  Synthetic oligonucleotide
gacggtactgtgggtt

SEQ ID NO: 2179 - DNA, 16 bp, Artificial sequence
  Synthetic oligonucleotide
accgccacctcagagg

SEQ ID NO: 2180 - DNA, 16 bp, Artificial sequence
  Synthetic oligonucleotide
acaacccacatcccgt

SEQ ID NO: 2181 - DNA, 16 bp, Artificial sequence
  Synthetic oligonucleotide
aatcacggtagctggg

SEQ ID NO: 2182 - DNA, 16 bp, Artificial sequence
  Synthetic oligonucleotide
ctggcagctgacatat

SEQ ID NO: 2183 - DNA, 16 bp, Artificial sequence
  Synthetic oligonucleotide
aagagagtctgagtgt

SEQ ID NO: 2184 - DNA, 16 bp, Artificial sequence
  Synthetic oligonucleotide
cggcgacattactatt

SEQ ID NO: 2185 - DNA, 16 bp, Artificial sequence
  Synthetic oligonucleotide
ttcagttaagtgctca

SEQ ID NO: 2186 - DNA, 16 bp, Artificial sequence
  Synthetic oligonucleotide
atggactctggtcaca

SEQ ID NO: 2187 - DNA, 16 bp, Artificial sequence
  Synthetic oligonucleotide
tcaaagttcatgctga

SEQ ID NO: 2188 - DNA, 16 bp, Artificial sequence
  Synthetic oligonucleotide
agagggtcataaactt

SEQ ID NO: 2189 - DNA, 16 bp, Artificial sequence
  Synthetic oligonucleotide
gaccagacaaccaaaa

SEQ ID NO: 2190 - DNA, 16 bp, Artificial sequence
  Synthetic oligonucleotide
tgaaaggttaataacc

SEQ ID NO: 2191 - DNA, 16 bp, Artificial sequence
  Synthetic oligonucleotide
tagaagccaacatagg

SEQ ID NO: 2192 - DNA, 16 bp, Artificial sequence
  Synthetic oligonucleotide
attataaccattgcag

SEQ ID NO: 2193 - DNA, 16 bp, Artificial sequence
  Synthetic oligonucleotide
cccagtttgaaatgtc

SEQ ID NO: 2194 - DNA, 16 bp, Artificial sequence
  Synthetic oligonucleotide
ttgtgatgaatgtggc

SEQ ID NO: 2195 - DNA, 16 bp, Artificial sequence
  Synthetic oligonucleotide
gaacatttgctggtct

SEQ ID NO: 2196 - DNA, 16 bp, Artificial sequence
  Synthetic oligonucleotide
ggactggctgagagat

SEQ ID NO: 2197 - DNA, 16 bp, Artificial sequence
  Synthetic oligonucleotide
catttcggtgaggccc

SEQ ID NO: 2198 - DNA, 16 bp, Artificial sequence
  Synthetic oligonucleotide
caactaggcctcctga

SEQ ID NO: 2199 - DNA, 16 bp, Artificial sequence
  Synthetic oligonucleotide
ctccgccagagatggc

SEQ ID NO: 2200 - DNA, 16 bp, Artificial sequence
  Synthetic oligonucleotide
gatcctagaatctcaa

SEQ ID NO: 2201 - DNA, 16 bp, Artificial sequence
  Synthetic oligonucleotide
gaggacccaggtttga

SEQ ID NO: 2202 - DNA, 16 bp, Artificial sequence
  Synthetic oligonucleotide
gacaccacggaggaag

SEQ ID NO: 2203 - DNA, 16 bp, Artificial sequence
  Synthetic oligonucleotide
ctgggccctgttgtca

SEQ ID NO: 2204 - DNA, 16 bp, Artificial sequence
  Synthetic oligonucleotide
acacatgtgggatggc

SEQ ID NO: 2205 - DNA, 16 bp, Artificial sequence
  Synthetic oligonucleotide
actcagttgtggtact

SEQ ID NO: 2206 - DNA, 16 bp, Artificial sequence
  Synthetic oligonucleotide
gagaatccaggtatta

SEQ ID NO: 2207 - DNA, 16 bp, Artificial sequence
  Synthetic oligonucleotide
gtcccatagtgacttg

SEQ ID NO: 2208 - DNA, 16 bp, Artificial sequence
  Synthetic oligonucleotide
tctattgtcctcacct

SEQ ID NO: 2209 - DNA, 16 bp, Artificial sequence
  Synthetic oligonucleotide
gtgtgatcatgcacgg

SEQ ID NO: 2210 - DNA, 16 bp, Artificial sequence
  Synthetic oligonucleotide
gacattacctgagatg

SEQ ID NO: 2211 - DNA, 16 bp, Artificial sequence
  Synthetic oligonucleotide
acttaatctgaagctg

SEQ ID NO: 2212 - DNA, 16 bp, Artificial sequence
  Synthetic oligonucleotide
ttgccccagtgactag

SEQ ID NO: 2213 - DNA, 16 bp, Artificial sequence
  Synthetic oligonucleotide
ccctggtgtggatgtg

SEQ ID NO: 2214 - DNA, 16 bp, Artificial sequence
  Synthetic oligonucleotide
gggcggtatgagatac

SEQ ID NO: 2215 - DNA, 16 bp, Artificial sequence
  Synthetic oligonucleotide
attttcttggccctgc

SEQ ID NO: 2216 - DNA, 16 bp, Artificial sequence
  Synthetic oligonucleotide
tggtagatgctatgat

SEQ ID NO: 2217 - DNA, 16 bp, Artificial sequence
  Synthetic oligonucleotide
catgtgggctgtggtt

SEQ ID NO: 2218 - DNA, 16 bp, Artificial sequence
  Synthetic oligonucleotide
gcctctgagacctgac

SEQ ID NO: 2219 - DNA, 16 bp, Artificial sequence
  Synthetic oligonucleotide
acggccattcgcaggt

SEQ ID NO: 2220 - DNA, 16 bp, Artificial sequence
  Synthetic oligonucleotide
gccactcacttgagga

SEQ ID NO: 2221 - DNA, 16 bp, Artificial sequence
  Synthetic oligonucleotide
gattttgatcaagaca

SEQ ID NO: 2222 - DNA, 16 bp, Artificial sequence
  Synthetic oligonucleotide
ctagaggagctagaac

SEQ ID NO: 2223 - DNA, 16 bp, Artificial sequence
  Synthetic oligonucleotide
agattccatgcaggtg

SEQ ID NO: 2224 - DNA, 16 bp, Artificial sequence
  Synthetic oligonucleotide
gaacttggtttctggc

SEQ ID NO: 2225 - DNA, 16 bp, Artificial sequence
  Synthetic oligonucleotide
atgtgaggttaggttc

SEQ ID NO: 2226 - DNA, 16 bp, Artificial sequence
  Synthetic oligonucleotide
gtggtcgccatcttga

SEQ ID NO: 2227 - DNA, 16 bp, Artificial sequence
  Synthetic oligonucleotide
tattagagcacaggtg

SEQ ID NO: 2228 - DNA, 16 bp, Artificial sequence
  Synthetic oligonucleotide
agtgcaaggaccattc

SEQ ID NO: 2229 - DNA, 16 bp, Artificial sequence
  Synthetic oligonucleotide
cactcgagaccatatg

SEQ ID NO: 2230 - DNA, 16 bp, Artificial sequence
  Synthetic oligonucleotide
ttacttagcagggtcc

SEQ ID NO: 2231 - DNA, 16 bp, Artificial sequence
  Synthetic oligonucleotide
tgagctcgggcgaatc

SEQ ID NO: 2232 - DNA, 16 bp, Artificial sequence
  Synthetic oligonucleotide
agcggagtaacttgca

SEQ ID NO: 2233 - DNA, 16 bp, Artificial sequence
  Synthetic oligonucleotide
gcacaggtactgtttg

SEQ ID NO: 2234 - DNA, 16 bp, Artificial sequence
  Synthetic oligonucleotide
cctagctagctccctg

SEQ ID NO: 2235 - DNA, 16 bp, Artificial sequence
  Synthetic oligonucleotide
ggaacccactctgagg

SEQ ID NO: 2236 - DNA, 16 bp, Artificial sequence
  Synthetic oligonucleotide
gctgaggtggacatct

SEQ ID NO: 2237 - DNA, 16 bp, Artificial sequence
  Synthetic oligonucleotide
ggtgtattgacatact

SEQ ID NO: 2238 - DNA, 16 bp, Artificial sequence
  Synthetic oligonucleotide
tcagggtttcagttca

SEQ ID NO: 2239 - DNA, 16 bp, Artificial sequence
  Synthetic oligonucleotide
ggcaaggatgaggtta

SEQ ID NO: 2240 - DNA, 16 bp, Artificial sequence
  Synthetic oligonucleotide
tgaaaggtctgggatg

SEQ ID NO: 2241 - DNA, 16 bp, Artificial sequence
  Synthetic oligonucleotide
aggtaatcagggacag

SEQ ID NO: 2242 - DNA, 16 bp, Artificial sequence
  Synthetic oligonucleotide
ctttgcttttataccg

SEQ ID NO: 2243 - DNA, 16 bp, Artificial sequence
  Synthetic oligonucleotide
ccagctgggcgaggct

SEQ ID NO: 2244 - DNA, 16 bp, Artificial sequence
  Synthetic oligonucleotide
aagaggaggcatgggc

SEQ ID NO: 2245 - DNA, 16 bp, Artificial sequence
  Synthetic oligonucleotide
atggctgggctctcca

SEQ ID NO: 2246 - DNA, 16 bp, Artificial sequence
  Synthetic oligonucleotide
agccgaaagggtgctg

SEQ ID NO: 2247 - DNA, 16 bp, Artificial sequence
  Synthetic oligonucleotide
gaagatggtccgcctg

SEQ ID NO: 2248 - DNA, 16 bp, Artificial sequence
  Synthetic oligonucleotide
cagcaggagcccttgt

SEQ ID NO: 2249 - DNA, 16 bp, Artificial sequence
  Synthetic oligonucleotide
tgaagtagtccatgtt

SEQ ID NO: 2250 - DNA, 16 bp, Artificial sequence
  Synthetic oligonucleotide
cacggtccacacagcc

SEQ ID NO: 2251 - DNA, 16 bp, Artificial sequence
  Synthetic oligonucleotide
agggcctatcatccct

SEQ ID NO: 2252 - DNA, 16 bp, Artificial sequence
  Synthetic oligonucleotide
ctgaagtaatctgtgc

SEQ ID NO: 2253 - DNA, 16 bp, Artificial sequence
  Synthetic oligonucleotide
gtgatgatgcagcttt

SEQ ID NO: 2254 - DNA, 16 bp, Artificial sequence
  Synthetic oligonucleotide
actcaagagacccact

SEQ ID NO: 2255 - DNA, 16 bp, Artificial sequence
  Synthetic oligonucleotide
ggacggtactgtgggt

SEQ ID NO: 2256 - DNA, 16 bp, Artificial sequence
  Synthetic oligonucleotide
caccgccacctcagag

SEQ ID NO: 2257 - DNA, 16 bp, Artificial sequence
  Synthetic oligonucleotide
aacaacccacatcccg

SEQ ID NO: 2258 - DNA, 16 bp, Artificial sequence
  Synthetic oligonucleotide
gaatcacggtagctgg

SEQ ID NO: 2259 - DNA, 16 bp, Artificial sequence
  Synthetic oligonucleotide
agactggcagctgaca

SEQ ID NO: 2260 - DNA, 16 bp, Artificial sequence
  Synthetic oligonucleotide
ccaggagagatgcggg

SEQ ID NO: 2261 - DNA, 16 bp, Artificial sequence
  Synthetic oligonucleotide
tcggcgacattactat

SEQ ID NO: 2262 - DNA, 16 bp, Artificial sequence
  Synthetic oligonucleotide
caaagttcagttaagt

SEQ ID NO: 2263 - DNA, 16 bp, Artificial sequence
  Synthetic oligonucleotide
aatatggactctggtc

SEQ ID NO: 2264 - DNA, 16 bp, Artificial sequence
  Synthetic oligonucleotide
atcaaagttcatgctg

SEQ ID NO: 2265 - DNA, 16 bp, Artificial sequence
  Synthetic oligonucleotide
agagagggtcataaac

SEQ ID NO: 2266 - DNA, 16 bp, Artificial sequence
  Synthetic oligonucleotide
gtaaggacatgaccag

SEQ ID NO: 2267 - DNA, 16 bp, Artificial sequence
  Synthetic oligonucleotide
gctgatgaaaggttaa

SEQ ID NO: 2268 - DNA, 16 bp, Artificial sequence
  Synthetic oligonucleotide
ctagaagccaacatag

SEQ ID NO: 2269 - DNA, 16 bp, Artificial sequence
  Synthetic oligonucleotide
tattataaccattgca

SEQ ID NO: 2270 - DNA, 16 bp, Artificial sequence
  Synthetic oligonucleotide
atcccaacaacccctc

SEQ ID NO: 2271 - DNA, 16 bp, Artificial sequence
  Synthetic oligonucleotide
acatatggagagaact

SEQ ID NO: 2272 - DNA, 16 bp, Artificial sequence
  Synthetic oligonucleotide
agaacatttgctggtc

SEQ ID NO: 2273 - DNA, 16 bp, Artificial sequence
  Synthetic oligonucleotide
gcccctctatccaggg

SEQ ID NO: 2274 - DNA, 16 bp, Artificial sequence
  Synthetic oligonucleotide
ctgcatttcggtgagg

SEQ ID NO: 2275 - DNA, 16 bp, Artificial sequence
  Synthetic oligonucleotide
ccaactaggcctcctg

SEQ ID NO: 2276 - DNA, 16 bp, Artificial sequence
  Synthetic oligonucleotide
cactccgccagagatg

SEQ ID NO: 2277 - DNA, 16 bp, Artificial sequence
  Synthetic oligonucleotide
ggatcctagaatctca

SEQ ID NO: 2278 - DNA, 16 bp, Artificial sequence
  Synthetic oligonucleotide
agaggacccaggtttg

SEQ ID NO: 2279 - DNA, 16 bp, Artificial sequence
  Synthetic oligonucleotide
cgacaccacggaggaa

SEQ ID NO: 2280 - DNA, 16 bp, Artificial sequence
  Synthetic oligonucleotide
gcatctgggccctgtt

SEQ ID NO: 2281 - DNA, 16 bp, Artificial sequence
  Synthetic oligonucleotide
caaacacatgtgggat

SEQ ID NO: 2282 - DNA, 16 bp, Artificial sequence
  Synthetic oligonucleotide
gatcaatttctgttgc

SEQ ID NO: 2283 - DNA, 16 bp, Artificial sequence
  Synthetic oligonucleotide
tgagaatccaggtatt

SEQ ID NO: 2284 - DNA, 16 bp, Artificial sequence
  Synthetic oligonucleotide
tagtcccatagtgact

SEQ ID NO: 2285 - DNA, 16 bp, Artificial sequence
  Synthetic oligonucleotide
cttctattgtcctcac

SEQ ID NO: 2286 - DNA, 16 bp, Artificial sequence
  Synthetic oligonucleotide
agtgtgatcatgcacg

SEQ ID NO: 2287 - DNA, 16 bp, Artificial sequence
  Synthetic oligonucleotide
tgacattacctgagat

SEQ ID NO: 2288 - DNA, 16 bp, Artificial sequence
  Synthetic oligonucleotide
agacttaatctgaagc

SEQ ID NO: 2289 - DNA, 16 bp, Artificial sequence
  Synthetic oligonucleotide
attttgccccagtgac

SEQ ID NO: 2290 - DNA, 16 bp, Artificial sequence
  Synthetic oligonucleotide
gccctggtgtggatgt

SEQ ID NO: 2291 - DNA, 16 bp, Artificial sequence
  Synthetic oligonucleotide
agggcggtatgagata

SEQ ID NO: 2292 - DNA, 16 bp, Artificial sequence
  Synthetic oligonucleotide
tccaatctctgaggcc

SEQ ID NO: 2293 - DNA, 16 bp, Artificial sequence
  Synthetic oligonucleotide
atggtagatgctatga

SEQ ID NO: 2294 - DNA, 16 bp, Artificial sequence
  Synthetic oligonucleotide
accgttgagagctggg

SEQ ID NO: 2295 - DNA, 16 bp, Artificial sequence
  Synthetic oligonucleotide
tggagtttccaagcct

SEQ ID NO: 2296 - DNA, 16 bp, Artificial sequence
  Synthetic oligonucleotide
gacggccattcgcagg

SEQ ID NO: 2297 - DNA, 16 bp, Artificial sequence
  Synthetic oligonucleotide
cggtagactggcacag

SEQ ID NO: 2298 - DNA, 16 bp, Artificial sequence
  Synthetic oligonucleotide
actgggagattttgat

SEQ ID NO: 2299 - DNA, 16 bp, Artificial sequence
  Synthetic oligonucleotide
tctagaggagctagaa

SEQ ID NO: 2300 - DNA, 16 bp, Artificial sequence
  Synthetic oligonucleotide
tagggagaagattcca

SEQ ID NO: 2301 - DNA, 16 bp, Artificial sequence
  Synthetic oligonucleotide
aggtgaacttggtttc

SEQ ID NO: 2302 - DNA, 16 bp, Artificial sequence
  Synthetic oligonucleotide
acctgaatgtgaggtt

SEQ ID NO: 2303 - DNA, 16 bp, Artificial sequence
  Synthetic oligonucleotide
ctgtggtcgccatctt

SEQ ID NO: 2304 - DNA, 16 bp, Artificial sequence
  Synthetic oligonucleotide
agccgtatttattaga

SEQ ID NO: 2305 - DNA, 16 bp, Artificial sequence
  Synthetic oligonucleotide
tagtgcaaggaccatt

SEQ ID NO: 2306 - DNA, 16 bp, Artificial sequence
  Synthetic oligonucleotide
acactcgagaccatat

SEQ ID NO: 2307 - DNA, 16 bp, Artificial sequence
  Synthetic oligonucleotide
attacttagcagggtc

SEQ ID NO: 2308 - DNA, 16 bp, Artificial sequence
  Synthetic oligonucleotide
ggtgagctcgggcgaa

SEQ ID NO: 2309 - DNA, 16 bp, Artificial sequence
  Synthetic oligonucleotide
aagcggagtaacttgc

SEQ ID NO: 2310 - DNA, 16 bp, Artificial sequence
  Synthetic oligonucleotide
gggcacaggtactgtt

SEQ ID NO: 2311 - DNA, 16 bp, Artificial sequence
  Synthetic oligonucleotide
tcctagctagctccct

SEQ ID NO: 2312 - DNA, 16 bp, Artificial sequence
  Synthetic oligonucleotide
aggaacccactctgag

SEQ ID NO: 2313 - DNA, 16 bp, Artificial sequence
  Synthetic oligonucleotide
ggctgaggtggacatc

SEQ ID NO: 2314 - DNA, 16 bp, Artificial sequence
  Synthetic oligonucleotide
ttgggaatggtgccca

SEQ ID NO: 2315 - DNA, 16 bp, Artificial sequence
  Synthetic oligonucleotide
gctaggtcagggtttc

SEQ ID NO: 2316 - DNA, 16 bp, Artificial sequence
  Synthetic oligonucleotide
ggttaggctcagggca

SEQ ID NO: 2317 - DNA, 16 bp, Artificial sequence
  Synthetic oligonucleotide
gtgaaaggtctgggat

SEQ ID NO: 2318 - DNA, 16 bp, Artificial sequence
  Synthetic oligonucleotide
gcaggtaatcagggac

SEQ ID NO: 2319 - DNA, 16 bp, Artificial sequence
  Synthetic oligonucleotide
cgtatcaaaaacaact

SEQ ID NO: 2320 - DNA, 16 bp, Artificial sequence
  Synthetic oligonucleotide
gctttgggtgcagccc

SEQ ID NO: 2321 - DNA, 16 bp, Artificial sequence
  Synthetic oligonucleotide
gcgatggtggcatggg

SEQ ID NO: 2322 - DNA, 16 bp, Artificial sequence
  Synthetic oligonucleotide
atcatggctgggctct

SEQ ID NO: 2323 - DNA, 16 bp, Artificial sequence
  Synthetic oligonucleotide
cagccgaaagggtgct

SEQ ID NO: 2324 - DNA, 16 bp, Artificial sequence
  Synthetic oligonucleotide
agaagatggtccgcct

SEQ ID NO: 2325 - DNA, 16 bp, Artificial sequence
  Synthetic oligonucleotide
ctacgatgcagcagga

SEQ ID NO: 2326 - DNA, 16 bp, Artificial sequence
  Synthetic oligonucleotide
acttgaagtagtccat

SEQ ID NO: 2327 - DNA, 16 bp, Artificial sequence
  Synthetic oligonucleotide
ggaactccagctcatc

SEQ ID NO: 2328 - DNA, 16 bp, Artificial sequence
  Synthetic oligonucleotide
cagggcctatcatccc

SEQ ID NO: 2329 - DNA, 16 bp, Artificial sequence
  Synthetic oligonucleotide
cctgaagtaatctgtg

SEQ ID NO: 2330 - DNA, 16 bp, Artificial sequence
  Synthetic oligonucleotide
tgtgatgatgcagctt

SEQ ID NO: 2331 - DNA, 16 bp, Artificial sequence
  Synthetic oligonucleotide
cgggactcaagagacc

SEQ ID NO: 2332 - DNA, 16 bp, Artificial sequence
  Synthetic oligonucleotide
tcggctgcagtttatt

SEQ ID NO: 2333 - DNA, 16 bp, Artificial sequence
  Synthetic oligonucleotide
agtcaccgccacctca

SEQ ID NO: 2334 - DNA, 16 bp, Artificial sequence
  Synthetic oligonucleotide
caacaacccacatccc

SEQ ID NO: 2335 - DNA, 16 bp, Artificial sequence
  Synthetic oligonucleotide
ggaatcacggtagctg

SEQ ID NO: 2336 - DNA, 16 bp, Artificial sequence
  Synthetic oligonucleotide
aagactggcagctgac

SEQ ID NO: 2337 - DNA, 16 bp, Artificial sequence
  Synthetic oligonucleotide
gccaggagagatgcgg

SEQ ID NO: 2338 - DNA, 16 bp, Artificial sequence
  Synthetic oligonucleotide
ctcggcgacattacta

SEQ ID NO: 2339 - DNA, 16 bp, Artificial sequence
  Synthetic oligonucleotide
gcaaagttcagttaag

SEQ ID NO: 2340 - DNA, 16 bp, Artificial sequence
  Synthetic oligonucleotide
gaatatggactctggt

SEQ ID NO: 2341 - DNA, 16 bp, Artificial sequence
  Synthetic oligonucleotide
caatcaaagttcatgc

SEQ ID NO: 2342 - DNA, 16 bp, Artificial sequence
  Synthetic oligonucleotide
cagagagggtcataaa

SEQ ID NO: 2343 - DNA, 16 bp, Artificial sequence
  Synthetic oligonucleotide
agtaaggacatgacca

SEQ ID NO: 2344 - DNA, 16 bp, Artificial sequence
  Synthetic oligonucleotide
ggctgatgaaaggtta

SEQ ID NO: 2345 - DNA, 16 bp, Artificial sequence
  Synthetic oligonucleotide
actagaagccaacata

SEQ ID NO: 2346 - DNA, 16 bp, Artificial sequence
  Synthetic oligonucleotide
ctattataaccattgc

SEQ ID NO: 2347 - DNA, 16 bp, Artificial sequence
  Synthetic oligonucleotide
ttatcccaacaacccc

SEQ ID NO: 2348 - DNA, 16 bp, Artificial sequence
  Synthetic oligonucleotide
cacatatggagagaac

SEQ ID NO: 2349 - DNA, 16 bp, Artificial sequence
  Synthetic oligonucleotide
ggattgcctcaaataa

SEQ ID NO: 2350 - DNA, 16 bp, Artificial sequence
  Synthetic oligonucleotide
caattgcccctctatc

SEQ ID NO: 2351 - DNA, 16 bp, Artificial sequence
  Synthetic oligonucleotide
actctgccgctgcatt

SEQ ID NO: 2352 - DNA, 16 bp, Artificial sequence
  Synthetic oligonucleotide
gccaactaggcctcct

SEQ ID NO: 2353 - DNA, 16 bp, Artificial sequence
  Synthetic oligonucleotide
ggccactccgccagag

SEQ ID NO: 2354 - DNA, 16 bp, Artificial sequence
  Synthetic oligonucleotide
aaggatcctagaatct

SEQ ID NO: 2355 - DNA, 16 bp, Artificial sequence
  Synthetic oligonucleotide
gagaggacccaggttt

SEQ ID NO: 2356 - DNA, 16 bp, Artificial sequence
  Synthetic oligonucleotide
atcgacaccacggagg

SEQ ID NO: 2357 - DNA, 16 bp, Artificial sequence
  Synthetic oligonucleotide
atgttttcatatcggg

SEQ ID NO: 2358 - DNA, 16 bp, Artificial sequence
  Synthetic oligonucleotide
ccaaacacatgtggga

SEQ ID NO: 2359 - DNA, 16 bp, Artificial sequence
  Synthetic oligonucleotide
ccttatggcccccaga

SEQ ID NO: 2360 - DNA, 16 bp, Artificial sequence
  Synthetic oligonucleotide
gtgagaatccaggtat

SEQ ID NO: 2361 - DNA, 16 bp, Artificial sequence
  Synthetic oligonucleotide
ttccgtagtcccatag

SEQ ID NO: 2362 - DNA, 16 bp, Artificial sequence
  Synthetic oligonucleotide
gctcttctattgtcct

SEQ ID NO: 2363 - DNA, 16 bp, Artificial sequence
  Synthetic oligonucleotide
tccaggagtgtgatca

SEQ ID NO: 2364 - DNA, 16 bp, Artificial sequence
  Synthetic oligonucleotide
gctgacattacctgag

SEQ ID NO: 2365 - DNA, 16 bp, Artificial sequence
  Synthetic oligonucleotide
tctgagacttaatctg

SEQ ID NO: 2366 - DNA, 16 bp, Artificial sequence
  Synthetic oligonucleotide
ctattttgccccagtg

SEQ ID NO: 2367 - DNA, 16 bp, Artificial sequence
  Synthetic oligonucleotide
agccctggtgtggatg

SEQ ID NO: 2368 - DNA, 16 bp, Artificial sequence
  Synthetic oligonucleotide
gctagggcggtatgag

SEQ ID NO: 2369 - DNA, 16 bp, Artificial sequence
  Synthetic oligonucleotide
ctccaatctctgaggc

SEQ ID NO: 2370 - DNA, 16 bp, Artificial sequence
  Synthetic oligonucleotide
catggtagatgctatg

SEQ ID NO: 2371 - DNA, 16 bp, Artificial sequence
  Synthetic oligonucleotide
taccaggtgggaggcc

SEQ ID NO: 2372 - DNA, 16 bp, Artificial sequence
  Synthetic oligonucleotide
taaggttctgcacctg

SEQ ID NO: 2373 - DNA, 16 bp, Artificial sequence
  Synthetic oligonucleotide
agacggccattcgcag

SEQ ID NO: 2374 - DNA, 16 bp, Artificial sequence
  Synthetic oligonucleotide
gccggtagactggcac

SEQ ID NO: 2375 - DNA, 16 bp, Artificial sequence
  Synthetic oligonucleotide
ggaactgggagatttt

SEQ ID NO: 2376 - DNA, 16 bp, Artificial sequence
  Synthetic oligonucleotide
atctagaggagctaga

SEQ ID NO: 2377 - DNA, 16 bp, Artificial sequence
  Synthetic oligonucleotide
gtagggagaagattcc

SEQ ID NO: 2378 - DNA, 16 bp, Artificial sequence
  Synthetic oligonucleotide
ccaggtgaacttggtt

SEQ ID NO: 2379 - DNA, 16 bp, Artificial sequence
  Synthetic oligonucleotide
ccctagctctcaggac

SEQ ID NO: 2380 - DNA, 16 bp, Artificial sequence
  Synthetic oligonucleotide
tctgtggtcgccatct

SEQ ID NO: 2381 - DNA, 16 bp, Artificial sequence
  Synthetic oligonucleotide
catgagccgtatttat

SEQ ID NO: 2382 - DNA, 16 bp, Artificial sequence
  Synthetic oligonucleotide
gtagtgcaaggaccat

SEQ ID NO: 2383 - DNA, 16 bp, Artificial sequence
  Synthetic oligonucleotide
cgacactcgagaccat

SEQ ID NO: 2384 - DNA, 16 bp, Artificial sequence
  Synthetic oligonucleotide
aattacttagcagggt

SEQ ID NO: 2385 - DNA, 16 bp, Artificial sequence
  Synthetic oligonucleotide
gataggtgagctcggg

SEQ ID NO: 2386 - DNA, 16 bp, Artificial sequence
  Synthetic oligonucleotide
gaagcggagtaacttg

SEQ ID NO: 2387 - DNA, 16 bp, Artificial sequence
  Synthetic oligonucleotide
acgggcacaggtactg

SEQ ID NO: 2388 - DNA, 16 bp, Artificial sequence
  Synthetic oligonucleotide
ctcctagctagctccc

SEQ ID NO: 2389 - DNA, 16 bp, Artificial sequence
  Synthetic oligonucleotide
gaggaacccactctga

SEQ ID NO: 2390 - DNA, 16 bp, Artificial sequence
  Synthetic oligonucleotide
agagggttaggtatgg

SEQ ID NO: 2391 - DNA, 16 bp, Artificial sequence
  Synthetic oligonucleotide
gaaaggttgggaatgg

SEQ ID NO: 2392 - DNA, 16 bp, Artificial sequence
  Synthetic oligonucleotide
agtgaggctatcagtc

SEQ ID NO: 2393 - DNA, 16 bp, Artificial sequence
  Synthetic oligonucleotide
gttaggtggttaggct

SEQ ID NO: 2394 - DNA, 16 bp, Artificial sequence
  Synthetic oligonucleotide
ggtgaaaggtctggga

SEQ ID NO: 2395 - DNA, 16 bp, Artificial sequence
  Synthetic oligonucleotide
agccatctgacatggg

SEQ ID NO: 2396 - DNA, 16 bp, Artificial sequence
  Synthetic oligonucleotide
gtgggaaactgtcacg

SEQ ID NO: 2397 - DNA, 16 bp, Artificial sequence
  Synthetic oligonucleotide
aggctttgggtgcagc

SEQ ID NO: 2398 - DNA, 16 bp, Artificial sequence
  Synthetic oligonucleotide
ctgcgatggtggcatg

SEQ ID NO: 2399 - DNA, 16 bp, Artificial sequence
  Synthetic oligonucleotide
gctgatcatggctggg

SEQ ID NO: 2400 - DNA, 16 bp, Artificial sequence
  Synthetic oligonucleotide
acagccgaaagggtgc

SEQ ID NO: 2401 - DNA, 16 bp, Artificial sequence
  Synthetic oligonucleotide
cagaagatggtccgcc

SEQ ID NO: 2402 - DNA, 16 bp, Artificial sequence
  Synthetic oligonucleotide
agctacgatgcagcag

SEQ ID NO: 2403 - DNA, 16 bp, Artificial sequence
  Synthetic oligonucleotide
aacttgaagtagtcca

SEQ ID NO: 2404 - DNA, 16 bp, Artificial sequence
  Synthetic oligonucleotide
cggaactccagctcat

SEQ ID NO: 2405 - DNA, 16 bp, Artificial sequence
  Synthetic oligonucleotide
ccagggcctatcatcc

SEQ ID NO: 2406 - DNA, 16 bp, Artificial sequence
  Synthetic oligonucleotide
ccctgaagtaatctgt

SEQ ID NO: 2407 - DNA, 16 bp, Artificial sequence
  Synthetic oligonucleotide
gtgtgatgatgcagct

SEQ ID NO: 2408 - DNA, 16 bp, Artificial sequence
  Synthetic oligonucleotide
acgggactcaagagac

SEQ ID NO: 2409 - DNA, 16 bp, Artificial sequence
  Synthetic oligonucleotide
ctcggctgcagtttat

SEQ ID NO: 2410 - DNA, 16 bp, Artificial sequence
  Synthetic oligonucleotide
cccagtcaccgccacc

SEQ ID NO: 2411 - DNA, 16 bp, Artificial sequence
  Synthetic oligonucleotide
ccaacaacccacatcc

SEQ ID NO: 2412 - DNA, 16 bp, Artificial sequence
  Synthetic oligonucleotide
tggaatcacggtagct

SEQ ID NO: 2413 - DNA, 16 bp, Artificial sequence
  Synthetic oligonucleotide
cataaagactggcagc

SEQ ID NO: 2414 - DNA, 16 bp, Artificial sequence
  Synthetic oligonucleotide
ggccaggagagatgcg

SEQ ID NO: 2415 - DNA, 16 bp, Artificial sequence
  Synthetic oligonucleotide
tcctcggcgacattac

SEQ ID NO: 2416 - DNA, 16 bp, Artificial sequence
  Synthetic oligonucleotide
gatacaagcaaagttc

SEQ ID NO: 2417 - DNA, 16 bp, Artificial sequence
  Synthetic oligonucleotide
ctgaatatggactctg

SEQ ID NO: 2418 - DNA, 16 bp, Artificial sequence
  Synthetic oligonucleotide
tcaatcaaagttcatg

SEQ ID NO: 2419 - DNA, 16 bp, Artificial sequence
  Synthetic oligonucleotide
gcagagagggtcataa

SEQ ID NO: 2420 - DNA, 16 bp, Artificial sequence
  Synthetic oligonucleotide
gagtaaggacatgacc

SEQ ID NO: 2421 - DNA, 16 bp, Artificial sequence
  Synthetic oligonucleotide
atggctgatgaaaggt

SEQ ID NO: 2422 - DNA, 16 bp, Artificial sequence
  Synthetic oligonucleotide
gactagaagccaacat

SEQ ID NO: 2423 - DNA, 16 bp, Artificial sequence
  Synthetic oligonucleotide
ctcctgaggaaggtac

SEQ ID NO: 2424 - DNA, 16 bp, Artificial sequence
  Synthetic oligonucleotide
cattatcccaacaacc

SEQ ID NO: 2425 - DNA, 16 bp, Artificial sequence
  Synthetic oligonucleotide
acccacatatggagag

SEQ ID NO: 2426 - DNA, 16 bp, Artificial sequence
  Synthetic oligonucleotide
gaggattgcctcaaat

SEQ ID NO: 2427 - DNA, 16 bp, Artificial sequence
  Synthetic oligonucleotide
cttcaagttgacaatt

SEQ ID NO: 2428 - DNA, 16 bp, Artificial sequence
  Synthetic oligonucleotide
gatttcaactctgccg

SEQ ID NO: 2429 - DNA, 16 bp, Artificial sequence
  Synthetic oligonucleotide
ggccaactaggcctcc

SEQ ID NO: 2430 - DNA, 16 bp, Artificial sequence
  Synthetic oligonucleotide
atggccactccgccag

SEQ ID NO: 2431 - DNA, 16 bp, Artificial sequence
  Synthetic oligonucleotide
aaaggatcctagaatc

SEQ ID NO: 2432 - DNA, 16 bp, Artificial sequence
  Synthetic oligonucleotide
ggagaggacccaggtt

SEQ ID NO: 2433 - DNA, 16 bp, Artificial sequence
  Synthetic oligonucleotide
catcgacaccacggag

SEQ ID NO: 2434 - DNA, 16 bp, Artificial sequence
  Synthetic oligonucleotide
tatgttttcatatcgg

SEQ ID NO: 2435 - DNA, 16 bp, Artificial sequence
  Synthetic oligonucleotide
cccaaacacatgtggg

SEQ ID NO: 2436 - DNA, 16 bp, Artificial sequence
  Synthetic oligonucleotide
cccttatggcccccag

SEQ ID NO: 2437 - DNA, 16 bp, Artificial sequence
  Synthetic oligonucleotide
gtgtgagaatccaggt

SEQ ID NO: 2438 - DNA, 16 bp, Artificial sequence
  Synthetic oligonucleotide
gccgagttccgtagtc

SEQ ID NO: 2439 - DNA, 16 bp, Artificial sequence
  Synthetic oligonucleotide
acgcaagacctgctct

SEQ ID NO: 2440 - DNA, 16 bp, Artificial sequence
  Synthetic oligonucleotide
gtccaggagtgtgatc

SEQ ID NO: 2441 - DNA, 16 bp, Artificial sequence
  Synthetic oligonucleotide
agctgacattacctga

SEQ ID NO: 2442 - DNA, 16 bp, Artificial sequence
  Synthetic oligonucleotide
gattctgagacttaat

SEQ ID NO: 2443 - DNA, 16 bp, Artificial sequence
  Synthetic oligonucleotide
cctattttgccccagt

SEQ ID NO: 2444 - DNA, 16 bp, Artificial sequence
  Synthetic oligonucleotide
cagccctggtgtggat

SEQ ID NO: 2445 - DNA, 16 bp, Artificial sequence
  Synthetic oligonucleotide
gtgctagggcggtatg

SEQ ID NO: 2446 - DNA, 16 bp, Artificial sequence
  Synthetic oligonucleotide
gcctccaatctctgag

SEQ ID NO: 2447 - DNA, 16 bp, Artificial sequence
  Synthetic oligonucleotide
cccacatggtagatgc

SEQ ID NO: 2448 - DNA, 16 bp, Artificial sequence
  Synthetic oligonucleotide
gttaccaggtgggagg

SEQ ID NO: 2449 - DNA, 16 bp, Artificial sequence
  Synthetic oligonucleotide
ttaaggttctgcacct

SEQ ID NO: 2450 - DNA, 16 bp, Artificial sequence
  Synthetic oligonucleotide
aagacggccattcgca

SEQ ID NO: 2451 - DNA, 16 bp, Artificial sequence
  Synthetic oligonucleotide
gggccggtagactggc

SEQ ID NO: 2452 - DNA, 16 bp, Artificial sequence
  Synthetic oligonucleotide
tctgtcactcaggaac

SEQ ID NO: 2453 - DNA, 16 bp, Artificial sequence
  Synthetic oligonucleotide
catctagaggagctag

SEQ ID NO: 2454 - DNA, 16 bp, Artificial sequence
  Synthetic oligonucleotide
agtagggagaagattc

SEQ ID NO: 2455 - DNA, 16 bp, Artificial sequence
  Synthetic oligonucleotide
cccaggtgaacttggt

SEQ ID NO: 2456 - DNA, 16 bp, Artificial sequence
  Synthetic oligonucleotide
catgtttggagctggg

SEQ ID NO: 2457 - DNA, 16 bp, Artificial sequence
  Synthetic oligonucleotide
tatgtggcaccctgtg

SEQ ID NO: 2458 - DNA, 16 bp, Artificial sequence
  Synthetic oligonucleotide
caaaacagcatgagcc

SEQ ID NO: 2459 - DNA, 16 bp, Artificial sequence
  Synthetic oligonucleotide
ggattaggagcttggg

SEQ ID NO: 2460 - DNA, 16 bp, Artificial sequence
  Synthetic oligonucleotide
cccgacactcgagacc

SEQ ID NO: 2461 - DNA, 16 bp, Artificial sequence
  Synthetic oligonucleotide
ggaattacttagcagg

SEQ ID NO: 2462 - DNA, 16 bp, Artificial sequence
  Synthetic oligonucleotide
ggataggtgagctcgg

SEQ ID NO: 2463 - DNA, 16 bp, Artificial sequence
  Synthetic oligonucleotide
agaagcggagtaactt

SEQ ID NO: 2464 - DNA, 16 bp, Artificial sequence
  Synthetic oligonucleotide
cacgggcacaggtact

SEQ ID NO: 2465 - DNA, 16 bp, Artificial sequence
  Synthetic oligonucleotide
cctcctagctagctcc

SEQ ID NO: 2466 - DNA, 16 bp, Artificial sequence
  Synthetic oligonucleotide
ggaggaacccactctg

SEQ ID NO: 2467 - DNA, 16 bp, Artificial sequence
  Synthetic oligonucleotide
gagagggttaggtatg

SEQ ID NO: 2468 - DNA, 16 bp, Artificial sequence
  Synthetic oligonucleotide
tacaaggaaaggttgg

SEQ ID NO: 2469 - DNA, 16 bp, Artificial sequence
  Synthetic oligonucleotide
cgatgatgattgcagt

SEQ ID NO: 2470 - DNA, 16 bp, Artificial sequence
  Synthetic oligonucleotide
ggttaggtggttaggc

SEQ ID NO: 2471 - DNA, 16 bp, Artificial sequence
  Synthetic oligonucleotide
gaggtgaaaggtctgg

SEQ ID NO: 2472 - DNA, 16 bp, Artificial sequence
  Synthetic oligonucleotide
cccgagccatctgaca

SEQ ID NO: 2473 - DNA, 16 bp, Artificial sequence
  Synthetic oligonucleotide
ttgtgggaaactgtca

SEQ ID NO: 2474 - DNA, 16 bp, Artificial sequence
  Synthetic oligonucleotide
agcaggtctgaggctt

SEQ ID NO: 2475 - DNA, 16 bp, Artificial sequence
  Synthetic oligonucleotide
gctgcgatggtggcat

SEQ ID NO: 2476 - DNA, 16 bp, Artificial sequence
  Synthetic oligonucleotide
gaggctgatcatggct

SEQ ID NO: 2477 - DNA, 16 bp, Artificial sequence
  Synthetic oligonucleotide
gcacagccgaaagggt

SEQ ID NO: 2478 - DNA, 16 bp, Artificial sequence
  Synthetic oligonucleotide
ccagaagatggtccgc

SEQ ID NO: 2479 - DNA, 16 bp, Artificial sequence
  Synthetic oligonucleotide
cagctacgatgcagca

SEQ ID NO: 2480 - DNA, 16 bp, Artificial sequence
  Synthetic oligonucleotide
gaacttgaagtagtcc

SEQ ID NO: 2481 - DNA, 16 bp, Artificial sequence
  Synthetic oligonucleotide
gcggaactccagctca

SEQ ID NO: 2482 - DNA, 16 bp, Artificial sequence
  Synthetic oligonucleotide
atccagggcctatcat

SEQ ID NO: 2483 - DNA, 16 bp, Artificial sequence
  Synthetic oligonucleotide
gccctgaagtaatctg

SEQ ID NO: 2484 - DNA, 16 bp, Artificial sequence
  Synthetic oligonucleotide
tgtgtgatgatgcagc

SEQ ID NO: 2485 - DNA, 16 bp, Artificial sequence
  Synthetic oligonucleotide
cacgggactcaagaga

SEQ ID NO: 2486 - DNA, 16 bp, Artificial sequence
  Synthetic oligonucleotide
gagctcggctgcagtt

SEQ ID NO: 2487 - DNA, 16 bp, Artificial sequence
  Synthetic oligonucleotide
tcccagtcaccgccac

SEQ ID NO: 2488 - DNA, 16 bp, Artificial sequence
  Synthetic oligonucleotide
caccaacaacccacat

SEQ ID NO: 2489 - DNA, 16 bp, Artificial sequence
  Synthetic oligonucleotide
ctggaatcacggtagc

SEQ ID NO: 2490 - DNA, 16 bp, Artificial sequence
  Synthetic oligonucleotide
atccataaagactggc

SEQ ID NO: 2491 - DNA, 16 bp, Artificial sequence
  Synthetic oligonucleotide
tcaagatggaggagac

SEQ ID NO: 2492 - DNA, 16 bp, Artificial sequence
  Synthetic oligonucleotide
taaaggtcctcggcga

SEQ ID NO: 2493 - DNA, 16 bp, Artificial sequence
  Synthetic oligonucleotide
cgatacaagcaaagtt

SEQ ID NO: 2494 - DNA, 16 bp, Artificial sequence
  Synthetic oligonucleotide
cctgaatatggactct

SEQ ID NO: 2495 - DNA, 16 bp, Artificial sequence
  Synthetic oligonucleotide
gtcaaatcaatcaaag

SEQ ID NO: 2496 - DNA, 16 bp, Artificial sequence
  Synthetic oligonucleotide
aattagcagagagggt

SEQ ID NO: 2497 - DNA, 16 bp, Artificial sequence
  Synthetic oligonucleotide
aggagtaaggacatga

SEQ ID NO: 2498 - DNA, 16 bp, Artificial sequence
  Synthetic oligonucleotide
gtaatggctgatgaaa

SEQ ID NO: 2499 - DNA, 16 bp, Artificial sequence
  Synthetic oligonucleotide
agactagaagccaaca

SEQ ID NO: 2500 - DNA, 16 bp, Artificial sequence
  Synthetic oligonucleotide
actcctgaggaaggta

SEQ ID NO: 2501 - DNA, 16 bp, Artificial sequence
  Synthetic oligonucleotide
ccattatcccaacaac

SEQ ID NO: 2502 - DNA, 16 bp, Artificial sequence
  Synthetic oligonucleotide
ttggacatggacccac

SEQ ID NO: 2503 - DNA, 16 bp, Artificial sequence
  Synthetic oligonucleotide
ggaggattgcctcaaa

SEQ ID NO: 2504 - DNA, 16 bp, Artificial sequence
  Synthetic oligonucleotide
agggcttcaagttgac

SEQ ID NO: 2505 - DNA, 16 bp, Artificial sequence
  Synthetic oligonucleotide
ggatttcaactctgcc

SEQ ID NO: 2506 - DNA, 16 bp, Artificial sequence
  Synthetic oligonucleotide
cgctctggccaactag

SEQ ID NO: 2507 - DNA, 16 bp, Artificial sequence
  Synthetic oligonucleotide
atacatggccactccg

SEQ ID NO: 2508 - DNA, 16 bp, Artificial sequence
  Synthetic oligonucleotide
taaaggatcctagaat

SEQ ID NO: 2509 - DNA, 16 bp, Artificial sequence
  Synthetic oligonucleotide
cttgggttgtggagag

SEQ ID NO: 2510 - DNA, 16 bp, Artificial sequence
  Synthetic oligonucleotide
tcatcgacaccacgga

SEQ ID NO: 2511 - DNA, 16 bp, Artificial sequence
  Synthetic oligonucleotide
ttatgttttcatatcg

SEQ ID NO: 2512 - DNA, 16 bp, Artificial sequence
  Synthetic oligonucleotide
ccccaaacacatgtgg

SEQ ID NO: 2513 - DNA, 16 bp, Artificial sequence
  Synthetic oligonucleotide
taacaaagattgccag

SEQ ID NO: 2514 - DNA, 16 bp, Artificial sequence
  Synthetic oligonucleotide
gatgagtgtgagaatc

SEQ ID NO: 2515 - DNA, 16 bp, Artificial sequence
  Synthetic oligonucleotide
atgccgagttccgtag

SEQ ID NO: 2516 - DNA, 16 bp, Artificial sequence
  Synthetic oligonucleotide
cacgcaagacctgctc

SEQ ID NO: 2517 - DNA, 16 bp, Artificial sequence
  Synthetic oligonucleotide
gcgagtccaggagtgt

SEQ ID NO: 2518 - DNA, 16 bp, Artificial sequence
  Synthetic oligonucleotide
accgagctgacattac

SEQ ID NO: 2519 - DNA, 16 bp, Artificial sequence
  Synthetic oligonucleotide
gtagattctgagactt

SEQ ID NO: 2520 - DNA, 16 bp, Artificial sequence
  Synthetic oligonucleotide
gtcctattttgcccca

SEQ ID NO: 2521 - DNA, 16 bp, Artificial sequence
  Synthetic oligonucleotide
cgctagcacagccctg

SEQ ID NO: 2522 - DNA, 16 bp, Artificial sequence
  Synthetic oligonucleotide
ggaaaggagtcacacg

SEQ ID NO: 2523 - DNA, 16 bp, Artificial sequence
  Synthetic oligonucleotide
ggagagcctccaatct

SEQ ID NO: 2524 - DNA, 16 bp, Artificial sequence
  Synthetic oligonucleotide
gcccacatggtagatg

SEQ ID NO: 2525 - DNA, 16 bp, Artificial sequence
  Synthetic oligonucleotide
tgttaccaggtgggag

SEQ ID NO: 2526 - DNA, 16 bp, Artificial sequence
  Synthetic oligonucleotide
tttaaggttctgcacc

SEQ ID NO: 2527 - DNA, 16 bp, Artificial sequence
  Synthetic oligonucleotide
aaagacggccattcgc

SEQ ID NO: 2528 - DNA, 16 bp, Artificial sequence
  Synthetic oligonucleotide
ccacaagccagggccg

SEQ ID NO: 2529 - DNA, 16 bp, Artificial sequence
  Synthetic oligonucleotide
ctagagcctggctaca

SEQ ID NO: 2530 - DNA, 16 bp, Artificial sequence
  Synthetic oligonucleotide
ccatctagaggagcta

SEQ ID NO: 2531 - DNA, 16 bp, Artificial sequence
  Synthetic oligonucleotide
taagtagggagaagat

SEQ ID NO: 2532 - DNA, 16 bp, Artificial sequence
  Synthetic oligonucleotide
tcccaggtgaacttgg

SEQ ID NO: 2533 - DNA, 16 bp, Artificial sequence
  Synthetic oligonucleotide
tgggcatgtttggagc

SEQ ID NO: 2534 - DNA, 16 bp, Artificial sequence
  Synthetic oligonucleotide
gttatgtggcaccctg

SEQ ID NO: 2535 - DNA, 16 bp, Artificial sequence
  Synthetic oligonucleotide
gtggaatcccacaaaa

SEQ ID NO: 2536 - DNA, 16 bp, Artificial sequence
  Synthetic oligonucleotide
caggattaggagcttg

SEQ ID NO: 2537 - DNA, 16 bp, Artificial sequence
  Synthetic oligonucleotide
gcccgacactcgagac

SEQ ID NO: 2538 - DNA, 16 bp, Artificial sequence
  Synthetic oligonucleotide
ctggaattacttagca

SEQ ID NO: 2539 - DNA, 16 bp, Artificial sequence
  Synthetic oligonucleotide
agtggataggtgagct

SEQ ID NO: 2540 - DNA, 16 bp, Artificial sequence
  Synthetic oligonucleotide
aagaagcggagtaact

SEQ ID NO: 2541 - DNA, 16 bp, Artificial sequence
  Synthetic oligonucleotide
ccacgggcacaggtac

SEQ ID NO: 2542 - DNA, 16 bp, Artificial sequence
  Synthetic oligonucleotide
acctcctagctagctc

SEQ ID NO: 2543 - DNA, 16 bp, Artificial sequence
  Synthetic oligonucleotide
tggaggaacccactct

SEQ ID NO: 2544 - DNA, 16 bp, Artificial sequence
  Synthetic oligonucleotide
ggagagggttaggtat

SEQ ID NO: 2545 - DNA, 16 bp, Artificial sequence
  Synthetic oligonucleotide
ttacaaggaaaggttg

SEQ ID NO: 2546 - DNA, 16 bp, Artificial sequence
  Synthetic oligonucleotide
gcgatgatgattgcag

SEQ ID NO: 2547 - DNA, 16 bp, Artificial sequence
  Synthetic oligonucleotide
tatcgagtatcttacg

SEQ ID NO: 2548 - DNA, 16 bp, Artificial sequence
  Synthetic oligonucleotide
gtgaggtgaaaggtct

SEQ ID NO: 2549 - DNA, 16 bp, Artificial sequence
  Synthetic oligonucleotide
accccgagccatctga

SEQ ID NO: 2550 - DNA, 16 bp, Artificial sequence
  Synthetic oligonucleotide
cttgtgggaaactgtc

SEQ ID NO: 2551 - DNA, 16 bp, Artificial sequence
  Synthetic oligonucleotide
cgggcccccagcaggt

SEQ ID NO: 2552 - DNA, 16 bp, Artificial sequence
  Synthetic oligonucleotide
agctgcgatggtggca

SEQ ID NO: 2553 - DNA, 16 bp, Artificial sequence
  Synthetic oligonucleotide
tgtgaggctgatcatg

SEQ ID NO: 2554 - DNA, 16 bp, Artificial sequence
  Synthetic oligonucleotide
gggcacagccgaaagg

SEQ ID NO: 2555 - DNA, 16 bp, Artificial sequence
  Synthetic oligonucleotide
tccagaagatggtccg

SEQ ID NO: 2556 - DNA, 16 bp, Artificial sequence
  Synthetic oligonucleotide
gcagctacgatgcagc

SEQ ID NO: 2557 - DNA, 16 bp, Artificial sequence
  Synthetic oligonucleotide
ggaacttgaagtagtc

SEQ ID NO: 2558 - DNA, 16 bp, Artificial sequence
  Synthetic oligonucleotide
ttgcggaactccagct

SEQ ID NO: 2559 - DNA, 16 bp, Artificial sequence
  Synthetic oligonucleotide
cctgtgggcacatcca

SEQ ID NO: 2560 - DNA, 16 bp, Artificial sequence
  Synthetic oligonucleotide
agccctgaagtaatct

SEQ ID NO: 2561 - DNA, 16 bp, Artificial sequence
  Synthetic oligonucleotide
gtgtgattgtgtgatg

SEQ ID NO: 2562 - DNA, 16 bp, Artificial sequence
  Synthetic oligonucleotide
gcacgggactcaagag

SEQ ID NO: 2563 - DNA, 16 bp, Artificial sequence
  Synthetic oligonucleotide
ggagctcggctgcagt

SEQ ID NO: 2564 - DNA, 16 bp, Artificial sequence
  Synthetic oligonucleotide
ccatcccagtcaccgc

SEQ ID NO: 2565 - DNA, 16 bp, Artificial sequence
  Synthetic oligonucleotide
tcaacctctgaggcca

SEQ ID NO: 2566 - DNA, 16 bp, Artificial sequence
  Synthetic oligonucleotide
gctggaatcacggtag

SEQ ID NO: 2567 - DNA, 16 bp, Artificial sequence
  Synthetic oligonucleotide
aagttgttcaaagctc

SEQ ID NO: 2568 - DNA, 16 bp, Artificial sequence
  Synthetic oligonucleotide
gtcaagatggaggaga

SEQ ID NO: 2569 - DNA, 16 bp, Artificial sequence
  Synthetic oligonucleotide
gtaaaggtcctcggcg

SEQ ID NO: 2570 - DNA, 16 bp, Artificial sequence
  Synthetic oligonucleotide
gcgatacaagcaaagt

SEQ ID NO: 2571 - DNA, 16 bp, Artificial sequence
  Synthetic oligonucleotide
tcctgaatatggactc

SEQ ID NO: 2572 - DNA, 16 bp, Artificial sequence
  Synthetic oligonucleotide
ggtcaaatcaatcaaa

SEQ ID NO: 2573 - DNA, 16 bp, Artificial sequence
  Synthetic oligonucleotide
gaattagcagagaggg

SEQ ID NO: 2574 - DNA, 16 bp, Artificial sequence
  Synthetic oligonucleotide
taggagtaaggacatg

SEQ ID NO: 2575 - DNA, 16 bp, Artificial sequence
  Synthetic oligonucleotide
atgtaatggctgatga

SEQ ID NO: 2576 - DNA, 16 bp, Artificial sequence
  Synthetic oligonucleotide
gagactagaagccaac

SEQ ID NO: 2577 - DNA, 16 bp, Artificial sequence
  Synthetic oligonucleotide
gactcctgaggaaggt

SEQ ID NO: 2578 - DNA, 16 bp, Artificial sequence
  Synthetic oligonucleotide
gtccattatcccaaca

SEQ ID NO: 2579 - DNA, 16 bp, Artificial sequence
  Synthetic oligonucleotide
cttggacatggaccca

SEQ ID NO: 2580 - DNA, 16 bp, Artificial sequence
  Synthetic oligonucleotide
gaggaggattgcctca

SEQ ID NO: 2581 - DNA, 16 bp, Artificial sequence
  Synthetic oligonucleotide
cagggcttcaagttga

SEQ ID NO: 2582 - DNA, 16 bp, Artificial sequence
  Synthetic oligonucleotide
atctaggcttggattt

SEQ ID NO: 2583 - DNA, 16 bp, Artificial sequence
  Synthetic oligonucleotide
cacgctctggccaact

SEQ ID NO: 2584 - DNA, 16 bp, Artificial sequence
  Synthetic oligonucleotide
aatacatggccactcc

SEQ ID NO: 2585 - DNA, 16 bp, Artificial sequence
  Synthetic oligonucleotide
atttaaaggatcctag

SEQ ID NO: 2586 - DNA, 16 bp, Artificial sequence
  Synthetic oligonucleotide
cttcttgggttgtgga

SEQ ID NO: 2587 - DNA, 16 bp, Artificial sequence
  Synthetic oligonucleotide
ttcatcgacaccacgg

SEQ ID NO: 2588 - DNA, 16 bp, Artificial sequence
  Synthetic oligonucleotide
tcagaagctgaatggg

SEQ ID NO: 2589 - DNA, 16 bp, Artificial sequence
  Synthetic oligonucleotide
gctaagaattctcccc

SEQ ID NO: 2590 - DNA, 16 bp, Artificial sequence
  Synthetic oligonucleotide
gcactggtgagatgag

SEQ ID NO: 2591 - DNA, 16 bp, Artificial sequence
  Synthetic oligonucleotide
tgagggagatgagtgt

SEQ ID NO: 2592 - DNA, 16 bp, Artificial sequence
  Synthetic oligonucleotide
ctcagatgccgagttc

SEQ ID NO: 2593 - DNA, 16 bp, Artificial sequence
  Synthetic oligonucleotide
ccacgcaagacctgct

SEQ ID NO: 2594 - DNA, 16 bp, Artificial sequence
  Synthetic oligonucleotide
aggcgagtccaggagt

SEQ ID NO: 2595 - DNA, 16 bp, Artificial sequence
  Synthetic oligonucleotide
gaccgagctgacatta

SEQ ID NO: 2596 - DNA, 16 bp, Artificial sequence
  Synthetic oligonucleotide
ggtagattctgagact

SEQ ID NO: 2597 - DNA, 16 bp, Artificial sequence
  Synthetic oligonucleotide
agtcctattttgcccc

SEQ ID NO: 2598 - DNA, 16 bp, Artificial sequence
  Synthetic oligonucleotide
cacgctagcacagccc

SEQ ID NO: 2599 - DNA, 16 bp, Artificial sequence
  Synthetic oligonucleotide
gggaaaggagtcacac

SEQ ID NO: 2600 - DNA, 16 bp, Artificial sequence
  Synthetic oligonucleotide
cctgagacagggattg

SEQ ID NO: 2601 - DNA, 16 bp, Artificial sequence
  Synthetic oligonucleotide
aagcccacatggtaga

SEQ ID NO: 2602 - DNA, 16 bp, Artificial sequence
  Synthetic oligonucleotide
ggtgttaccaggtggg

SEQ ID NO: 2603 - DNA, 16 bp, Artificial sequence
  Synthetic oligonucleotide
ctttaaggttctgcac

SEQ ID NO: 2604 - DNA, 16 bp, Artificial sequence
  Synthetic oligonucleotide
taaagacggccattcg

SEQ ID NO: 2605 - DNA, 16 bp, Artificial sequence
  Synthetic oligonucleotide
accctagacctctccc

SEQ ID NO: 2606 - DNA, 16 bp, Artificial sequence
  Synthetic oligonucleotide
attctagagcctggct

SEQ ID NO: 2607 - DNA, 16 bp, Artificial sequence
  Synthetic oligonucleotide
gccatctagaggagct

SEQ ID NO: 2608 - DNA, 16 bp, Artificial sequence
  Synthetic oligonucleotide
ctaagtagggagaaga

SEQ ID NO: 2609 - DNA, 16 bp, Artificial sequence
  Synthetic oligonucleotide
tcctttataccagccc

SEQ ID NO: 2610 - DNA, 16 bp, Artificial sequence
  Synthetic oligonucleotide
ctgggcatgtttggag

SEQ ID NO: 2611 - DNA, 16 bp, Artificial sequence
  Synthetic oligonucleotide
tggttatgtggcaccc

SEQ ID NO: 2612 - DNA, 16 bp, Artificial sequence
  Synthetic oligonucleotide
tctgaggtggaatccc

SEQ ID NO: 2613 - DNA, 16 bp, Artificial sequence
  Synthetic oligonucleotide
tcaggattaggagctt

SEQ ID NO: 2614 - DNA, 16 bp, Artificial sequence
  Synthetic oligonucleotide
ccccaagggagtcagg

SEQ ID NO: 2615 - DNA, 16 bp, Artificial sequence
  Synthetic oligonucleotide
cctggaattacttagc

SEQ ID NO: 2616 - DNA, 16 bp, Artificial sequence
  Synthetic oligonucleotide
cagtggataggtgagc

SEQ ID NO: 2617 - DNA, 16 bp, Artificial sequence
  Synthetic oligonucleotide
aaagaagcggagtaac

SEQ ID NO: 2618 - DNA, 16 bp, Artificial sequence
  Synthetic oligonucleotide
tccacgggcacaggta

SEQ ID NO: 2619 - DNA, 16 bp, Artificial sequence
  Synthetic oligonucleotide
ggacctcctagctagc

SEQ ID NO: 2620 - DNA, 16 bp, Artificial sequence
  Synthetic oligonucleotide
atggaggaacccactc

SEQ ID NO: 2621 - DNA, 16 bp, Artificial sequence
  Synthetic oligonucleotide
aggagagggttaggta

SEQ ID NO: 2622 - DNA, 16 bp, Artificial sequence
  Synthetic oligonucleotide
gtgttacaaggaaagg

SEQ ID NO: 2623 - DNA, 16 bp, Artificial sequence
  Synthetic oligonucleotide
cagcgatgatgattgc

SEQ ID NO: 2624 - DNA, 16 bp, Artificial sequence
  Synthetic oligonucleotide
ttatcgagtatcttac

SEQ ID NO: 2625 - DNA, 16 bp, Artificial sequence
  Synthetic oligonucleotide
agtgaggtgaaaggtc

SEQ ID NO: 2626 - DNA, 16 bp, Artificial sequence
  Synthetic oligonucleotide
cctaccccgagccatc

SEQ ID NO: 2627 - DNA, 16 bp, Artificial sequence
  Synthetic oligonucleotide
gcttgtgggaaactgt

SEQ ID NO: 2628 - DNA, 16 bp, Artificial sequence
  Synthetic oligonucleotide
tccccctgggccccgg

SEQ ID NO: 2629 - DNA, 16 bp, Artificial sequence
  Synthetic oligonucleotide
gccaccatgactaggg

SEQ ID NO: 2630 - DNA, 16 bp, Artificial sequence
  Synthetic oligonucleotide
cggtggtgggtggtgt

SEQ ID NO: 2631 - DNA, 16 bp, Artificial sequence
  Synthetic oligonucleotide
gtgggtaggagctctg

SEQ ID NO: 2632 - DNA, 16 bp, Artificial sequence
  Synthetic oligonucleotide
atccagaagatggtcc

SEQ ID NO: 2633 - DNA, 16 bp, Artificial sequence
  Synthetic oligonucleotide
cagcagctacgatgca

SEQ ID NO: 2634 - DNA, 16 bp, Artificial sequence
  Synthetic oligonucleotide
gtggaacttgaagtag

SEQ ID NO: 2635 - DNA, 16 bp, Artificial sequence
  Synthetic oligonucleotide
cttgcggaactccagc

SEQ ID NO: 2636 - DNA, 16 bp, Artificial sequence
  Synthetic oligonucleotide
ccctgtgggcacatcc

SEQ ID NO: 2637 - DNA, 16 bp, Artificial sequence
  Synthetic oligonucleotide
cagccctgaagtaatc

SEQ ID NO: 2638 - DNA, 16 bp, Artificial sequence
  Synthetic oligonucleotide
cctgtgttgacagtgc

SEQ ID NO: 2639 - DNA, 16 bp, Artificial sequence
  Synthetic oligonucleotide
tgcacgggactcaaga

SEQ ID NO: 2640 - DNA, 16 bp, Artificial sequence
  Synthetic oligonucleotide
cacttgaggccatccc

SEQ ID NO: 2641 - DNA, 16 bp, Artificial sequence
  Synthetic oligonucleotide
gtcaacctctgaggcc

SEQ ID NO: 2642 - DNA, 16 bp, Artificial sequence
  Synthetic oligonucleotide
tggctggaatcacggt

SEQ ID NO: 2643 - DNA, 16 bp, Artificial sequence
  Synthetic oligonucleotide
caagttgttcaaagct

SEQ ID NO: 2644 - DNA, 16 bp, Artificial sequence
  Synthetic oligonucleotide
ggtcaagatggaggag

SEQ ID NO: 2645 - DNA, 16 bp, Artificial sequence
  Synthetic oligonucleotide
tgtaaaggtcctcggc

SEQ ID NO: 2646 - DNA, 16 bp, Artificial sequence
  Synthetic oligonucleotide
agcgatacaagcaaag

SEQ ID NO: 2647 - DNA, 16 bp, Artificial sequence
  Synthetic oligonucleotide
gaacaacctgtttgct

SEQ ID NO: 2648 - DNA, 16 bp, Artificial sequence
  Synthetic oligonucleotide
cacttggtcaaatcaa

SEQ ID NO: 2649 - DNA, 16 bp, Artificial sequence
  Synthetic oligonucleotide
gagaattagcagagag

SEQ ID NO: 2650 - DNA, 16 bp, Artificial sequence
  Synthetic oligonucleotide
attaggagtaaggaca

SEQ ID NO: 2651 - DNA, 16 bp, Artificial sequence
  Synthetic oligonucleotide
tatgtaatggctgatg

SEQ ID NO: 2652 - DNA, 16 bp, Artificial sequence
  Synthetic oligonucleotide
ccataaaagagactag

SEQ ID NO: 2653 - DNA, 16 bp, Artificial sequence
  Synthetic oligonucleotide
caaagactcctgagga

SEQ ID NO: 2654 - DNA, 16 bp, Artificial sequence
  Synthetic oligonucleotide
agtccattatcccaac

SEQ ID NO: 2655 - DNA, 16 bp, Artificial sequence
  Synthetic oligonucleotide
agcttggacatggacc

SEQ ID NO: 2656 - DNA, 16 bp, Artificial sequence
  Synthetic oligonucleotide
agaggaggattgcctc

SEQ ID NO: 2657 - DNA, 16 bp, Artificial sequence
  Synthetic oligonucleotide
tgcagggcttcaagtt

SEQ ID NO: 2658 - DNA, 16 bp, Artificial sequence
  Synthetic oligonucleotide
gatctaggcttggatt

SEQ ID NO: 2659 - DNA, 16 bp, Artificial sequence
  Synthetic oligonucleotide
ccacgctctggccaac

SEQ ID NO: 2660 - DNA, 16 bp, Artificial sequence
  Synthetic oligonucleotide
aaatacatggccactc

SEQ ID NO: 2661 - DNA, 16 bp, Artificial sequence
  Synthetic oligonucleotide
gatttaaaggatccta

SEQ ID NO: 2662 - DNA, 16 bp, Artificial sequence
  Synthetic oligonucleotide
cccttcttgggttgtg

SEQ ID NO: 2663 - DNA, 16 bp, Artificial sequence
  Synthetic oligonucleotide
cttcatcgacaccacg

SEQ ID NO: 2664 - DNA, 16 bp, Artificial sequence
  Synthetic oligonucleotide
ctgactgggtttctca

SEQ ID NO: 2665 - DNA, 16 bp, Artificial sequence
  Synthetic oligonucleotide
agctaagaattctccc

SEQ ID NO: 2666 - DNA, 16 bp, Artificial sequence
  Synthetic oligonucleotide
agcactggtgagatga

SEQ ID NO: 2667 - DNA, 16 bp, Artificial sequence
  Synthetic oligonucleotide
gagcagttgctccttc

SEQ ID NO: 2668 - DNA, 16 bp, Artificial sequence
  Synthetic oligonucleotide
gctcagatgccgagtt

SEQ ID NO: 2669 - DNA, 16 bp, Artificial sequence
  Synthetic oligonucleotide
agccacgcaagacctg

SEQ ID NO: 2670 - DNA, 16 bp, Artificial sequence
  Synthetic oligonucleotide
gaggcgagtccaggag

SEQ ID NO: 2671 - DNA, 16 bp, Artificial sequence
  Synthetic oligonucleotide
ggaccgagctgacatt

SEQ ID NO: 2672 - DNA, 16 bp, Artificial sequence
  Synthetic oligonucleotide
agtgggtagattctga

SEQ ID NO: 2673 - DNA, 16 bp, Artificial sequence
  Synthetic oligonucleotide
gagtcctattttgccc

SEQ ID NO: 2674 - DNA, 16 bp, Artificial sequence
  Synthetic oligonucleotide
ccacgctagcacagcc

SEQ ID NO: 2675 - DNA, 16 bp, Artificial sequence
  Synthetic oligonucleotide
ggtaccccaccctgcc

SEQ ID NO: 2676 - DNA, 16 bp, Artificial sequence
  Synthetic oligonucleotide
aatacggcctcctcct

SEQ ID NO: 2677 - DNA, 16 bp, Artificial sequence
  Synthetic oligonucleotide
caagcccacatggtag

SEQ ID NO: 2678 - DNA, 16 bp, Artificial sequence
  Synthetic oligonucleotide
aggtgttaccaggtgg

SEQ ID NO: 2679 - DNA, 16 bp, Artificial sequence
  Synthetic oligonucleotide
gcatctttaaggttct

SEQ ID NO: 2680 - DNA, 16 bp, Artificial sequence
  Synthetic oligonucleotide
ttaaagacggccattc

SEQ ID NO: 2681 - DNA, 16 bp, Artificial sequence
  Synthetic oligonucleotide
ttattgggatgaagcc

SEQ ID NO: 2682 - DNA, 16 bp, Artificial sequence
  Synthetic oligonucleotide
gggcaaagcaggagtg

SEQ ID NO: 2683 - DNA, 16 bp, Artificial sequence
  Synthetic oligonucleotide
agccatctagaggagc

SEQ ID NO: 2684 - DNA, 16 bp, Artificial sequence
  Synthetic oligonucleotide
cctaagtagggagaag

SEQ ID NO: 2685 - DNA, 16 bp, Artificial sequence
  Synthetic oligonucleotide
ttccctgggagtgccc

SEQ ID NO: 2686 - DNA, 16 bp, Artificial sequence
  Synthetic oligonucleotide
aggtctgggcatgttt

SEQ ID NO: 2687 - DNA, 16 bp, Artificial sequence
  Synthetic oligonucleotide
gtggttatgtggcacc

SEQ ID NO: 2688 - DNA, 16 bp, Artificial sequence
  Synthetic oligonucleotide
gccctcttctaaattc

SEQ ID NO: 2689 - DNA, 16 bp, Artificial sequence
  Synthetic oligonucleotide
tgtcaggattaggagc

SEQ ID NO: 2690 - DNA, 16 bp, Artificial sequence
  Synthetic oligonucleotide
cccaatccccaaggga

SEQ ID NO: 2691 - DNA, 16 bp, Artificial sequence
  Synthetic oligonucleotide
tcctggaattacttag

SEQ ID NO: 2692 - DNA, 16 bp, Artificial sequence
  Synthetic oligonucleotide
gcagtggataggtgag

SEQ ID NO: 2693 - DNA, 16 bp, Artificial sequence
  Synthetic oligonucleotide
aaaagaagcggagtaa

SEQ ID NO: 2694 - DNA, 16 bp, Artificial sequence
  Synthetic oligonucleotide
gtccacgggcacaggt

SEQ ID NO: 2695 - DNA, 16 bp, Artificial sequence
  Synthetic oligonucleotide
aggacctcctagctag

SEQ ID NO: 2696 - DNA, 16 bp, Artificial sequence
  Synthetic oligonucleotide
aatggaggaacccact

SEQ ID NO: 2697 - DNA, 16 bp, Artificial sequence
  Synthetic oligonucleotide
caggagagggttaggt

SEQ ID NO: 2698 - DNA, 16 bp, Artificial sequence
  Synthetic oligonucleotide
caaatgggtgttacaa

SEQ ID NO: 2699 - DNA, 16 bp, Artificial sequence
  Synthetic oligonucleotide
tcagcgatgatgattg

SEQ ID NO: 2700 - DNA, 16 bp, Artificial sequence
  Synthetic oligonucleotide
attatcgagtatctta

SEQ ID NO: 2701 - DNA, 16 bp, Artificial sequence
  Synthetic oligonucleotide
gctagggctgaagtga

SEQ ID NO: 2702 - DNA, 16 bp, Artificial sequence
  Synthetic oligonucleotide
tatgacctaccccgag

SEQ ID NO: 2703 - DNA, 16 bp, Artificial sequence
  Synthetic oligonucleotide
tggcttgtgggaaact

SEQ ID NO: 2704 - DNA, 16 bp, Artificial sequence
  Synthetic oligonucleotide
ggaaggttccccctgg

SEQ ID NO: 2705 - DNA, 16 bp, Artificial sequence
  Synthetic oligonucleotide
cggagggtgccaccat

SEQ ID NO: 2706 - DNA, 16 bp, Artificial sequence
  Synthetic oligonucleotide
ccccagtggcggtggt

SEQ ID NO: 2707 - DNA, 16 bp, Artificial sequence
  Synthetic oligonucleotide
agtgggtaggagctct

SEQ ID NO: 2708 - DNA, 16 bp, Artificial sequence
  Synthetic oligonucleotide
gcccttctcatccaga

SEQ ID NO: 2709 - DNA, 16 bp, Artificial sequence
  Synthetic oligonucleotide
cgacagggccttggct

SEQ ID NO: 2710 - DNA, 16 bp, Artificial sequence
  Synthetic oligonucleotide
tgtggaacttgaagta

SEQ ID NO: 2711 - DNA, 16 bp, Artificial sequence
  Synthetic oligonucleotide
tttcttgcggaactcc

SEQ ID NO: 2712 - DNA, 16 bp, Artificial sequence
  Synthetic oligonucleotide
cctcacttcttggtcc

SEQ ID NO: 2713 - DNA, 16 bp, Artificial sequence
  Synthetic oligonucleotide
acaggattgtgacatt

SEQ ID NO: 2714 - DNA, 16 bp, Artificial sequence
  Synthetic oligonucleotide
cacacccctgtgttga

SEQ ID NO: 2715 - DNA, 16 bp, Artificial sequence
  Synthetic oligonucleotide
ctgcacgggactcaag

SEQ ID NO: 2716 - DNA, 16 bp, Artificial sequence
  Synthetic oligonucleotide
gcacttgaggccatcc

SEQ ID NO: 2717 - DNA, 16 bp, Artificial sequence
  Synthetic oligonucleotide
tctgtggaaggccggg

SEQ ID NO: 2718 - DNA, 16 bp, Artificial sequence
  Synthetic oligonucleotide
ctggctggaatcacgg

SEQ ID NO: 2719 - DNA, 16 bp, Artificial sequence
  Synthetic oligonucleotide
gcatttcaagttgttc

SEQ ID NO: 2720 - DNA, 16 bp, Artificial sequence
  Synthetic oligonucleotide
atcgatggagtgtggt

SEQ ID NO: 2721 - DNA, 16 bp, Artificial sequence
  Synthetic oligonucleotide
atgtaaaggtcctcgg

SEQ ID NO: 2722 - DNA, 16 bp, Artificial sequence
  Synthetic oligonucleotide
aagcgatacaagcaaa

SEQ ID NO: 2723 - DNA, 16 bp, Artificial sequence
  Synthetic oligonucleotide
ctgaacaacctgtttg

SEQ ID NO: 2724 - DNA, 16 bp, Artificial sequence
  Synthetic oligonucleotide
gcacttggtcaaatca

SEQ ID NO: 2725 - DNA, 16 bp, Artificial sequence
  Synthetic oligonucleotide
ggacaaccttttggaa

SEQ ID NO: 2726 - DNA, 16 bp, Artificial sequence
  Synthetic oligonucleotide
tattaggagtaaggac

SEQ ID NO: 2727 - DNA, 16 bp, Artificial sequence
  Synthetic oligonucleotide
atatgtaatggctgat

SEQ ID NO: 2728 - DNA, 16 bp, Artificial sequence
  Synthetic oligonucleotide
gccataaaagagacta

SEQ ID NO: 2729 - DNA, 16 bp, Artificial sequence
  Synthetic oligonucleotide
tctaaacaaagactcc

SEQ ID NO: 2730 - DNA, 16 bp, Artificial sequence
  Synthetic oligonucleotide
tagtcagtccattatc

SEQ ID NO: 2731 - DNA, 16 bp, Artificial sequence
  Synthetic oligonucleotide
aagcttggacatggac

SEQ ID NO: 2732 - DNA, 16 bp, Artificial sequence
  Synthetic oligonucleotide
cgagaggaggattgcc

SEQ ID NO: 2733 - DNA, 16 bp, Artificial sequence
  Synthetic oligonucleotide
ctgcagggcttcaagt

SEQ ID NO: 2734 - DNA, 16 bp, Artificial sequence
  Synthetic oligonucleotide
agatctaggcttggat

SEQ ID NO: 2735 - DNA, 16 bp, Artificial sequence
  Synthetic oligonucleotide
caccacgctctggcca

SEQ ID NO: 2736 - DNA, 16 bp, Artificial sequence
  Synthetic oligonucleotide
caaatacatggccact

SEQ ID NO: 2737 - DNA, 16 bp, Artificial sequence
  Synthetic oligonucleotide
ttagatttaaaggatc

SEQ ID NO: 2738 - DNA, 16 bp, Artificial sequence
  Synthetic oligonucleotide
tggcccttcttgggtt

SEQ ID NO: 2739 - DNA, 16 bp, Artificial sequence
  Synthetic oligonucleotide
cgggcttcatcgacac

SEQ ID NO: 2740 - DNA, 16 bp, Artificial sequence
  Synthetic oligonucleotide
cctttctgactgggtt

SEQ ID NO: 2741 - DNA, 16 bp, Artificial sequence
  Synthetic oligonucleotide
gagctaagaattctcc

SEQ ID NO: 2742 - DNA, 16 bp, Artificial sequence
  Synthetic oligonucleotide
gagcactggtgagatg

SEQ ID NO: 2743 - DNA, 16 bp, Artificial sequence
  Synthetic oligonucleotide
tatagaagggttctgg

SEQ ID NO: 2744 - DNA, 16 bp, Artificial sequence
  Synthetic oligonucleotide
agccaaccccattata

SEQ ID NO: 2745 - DNA, 16 bp, Artificial sequence
  Synthetic oligonucleotide
gtccaagccacgcaag

SEQ ID NO: 2746 - DNA, 16 bp, Artificial sequence
  Synthetic oligonucleotide
ggaggcgagtccagga

SEQ ID NO: 2747 - DNA, 16 bp, Artificial sequence
  Synthetic oligonucleotide
aggaccgagctgacat

SEQ ID NO: 2748 - DNA, 16 bp, Artificial sequence
  Synthetic oligonucleotide
cgagaagtgggtagat

SEQ ID NO: 2749 - DNA, 16 bp, Artificial sequence
  Synthetic oligonucleotide
ctcggagtcctatttt

SEQ ID NO: 2750 - DNA, 16 bp, Artificial sequence
  Synthetic oligonucleotide
gcccacgctagcacag

SEQ ID NO: 2751 - DNA, 16 bp, Artificial sequence
  Synthetic oligonucleotide
aggtaccccaccctgc

SEQ ID NO: 2752 - DNA, 16 bp, Artificial sequence
  Synthetic oligonucleotide
caatacggcctcctcc

SEQ ID NO: 2753 - DNA, 16 bp, Artificial sequence
  Synthetic oligonucleotide
tgcaagcccacatggt

SEQ ID NO: 2754 - DNA, 16 bp, Artificial sequence
  Synthetic oligonucleotide
gaggtgttaccaggtg

SEQ ID NO: 2755 - DNA, 16 bp, Artificial sequence
  Synthetic oligonucleotide
tgcatctttaaggttc

SEQ ID NO: 2756 - DNA, 16 bp, Artificial sequence
  Synthetic oligonucleotide
cttaaagacggccatt

SEQ ID NO: 2757 - DNA, 16 bp, Artificial sequence
  Synthetic oligonucleotide
cttattgggatgaagc

SEQ ID NO: 2758 - DNA, 16 bp, Artificial sequence
  Synthetic oligonucleotide
tagcagggcaaagcag

SEQ ID NO: 2759 - DNA, 16 bp, Artificial sequence
  Synthetic oligonucleotide
cagcagccatctagag

SEQ ID NO: 2760 - DNA, 16 bp, Artificial sequence
  Synthetic oligonucleotide
gcctaagtagggagaa

SEQ ID NO: 2761 - DNA, 16 bp, Artificial sequence
  Synthetic oligonucleotide
gctacggtcttccctg

SEQ ID NO: 2762 - DNA, 16 bp, Artificial sequence
  Synthetic oligonucleotide
gacagatttccaggtc

SEQ ID NO: 2763 - DNA, 16 bp, Artificial sequence
  Synthetic oligonucleotide
gacctatgtggttatg

SEQ ID NO: 2764 - DNA, 16 bp, Artificial sequence
  Synthetic oligonucleotide
acgccctcttctaaat

SEQ ID NO: 2765 - DNA, 16 bp, Artificial sequence
  Synthetic oligonucleotide
gctcctttgcaccctc

SEQ ID NO: 2766 - DNA, 16 bp, Artificial sequence
  Synthetic oligonucleotide
atggccccaatcccca

SEQ ID NO: 2767 - DNA, 16 bp, Artificial sequence
  Synthetic oligonucleotide
ctcctggaattactta

SEQ ID NO: 2768 - DNA, 16 bp, Artificial sequence
  Synthetic oligonucleotide
agcagtggataggtga

SEQ ID NO: 2769 - DNA, 16 bp, Artificial sequence
  Synthetic oligonucleotide
gaaaagaagcggagta

SEQ ID NO: 2770 - DNA, 16 bp, Artificial sequence
  Synthetic oligonucleotide
caacacccgtgtccac

SEQ ID NO: 2771 - DNA, 16 bp, Artificial sequence
  Synthetic oligonucleotide
caggacctcctagcta

SEQ ID NO: 2772 - DNA, 16 bp, Artificial sequence
  Synthetic oligonucleotide
gaatggaggaacccac

SEQ ID NO: 2773 - DNA, 16 bp, Artificial sequence
  Synthetic oligonucleotide
ccaggagagggttagg

SEQ ID NO: 2774 - DNA, 16 bp, Artificial sequence
  Synthetic oligonucleotide
tcaaatgggtgttaca

SEQ ID NO: 2775 - DNA, 16 bp, Artificial sequence
  Synthetic oligonucleotide
gtcagcgatgatgatt

SEQ ID NO: 2776 - DNA, 16 bp, Artificial sequence
  Synthetic oligonucleotide
aattatcgagtatctt

SEQ ID NO: 2777 - DNA, 16 bp, Artificial sequence
  Synthetic oligonucleotide
ggctagggctgaagtg

SEQ ID NO: 2778 - DNA, 16 bp, Artificial sequence
  Synthetic oligonucleotide
ctatgacctaccccga

SEQ ID NO: 2779 - DNA, 16 bp, Artificial sequence
  Synthetic oligonucleotide
tcagggacatggttag

SEQ ID NO: 2780 - DNA, 16 bp, Artificial sequence
  Synthetic oligonucleotide
actttgcttttatacc

SEQ ID NO: 2781 - DNA, 16 bp, Artificial sequence
  Synthetic oligonucleotide
gggccccgcctcgaag

SEQ ID NO: 2782 - DNA, 16 bp, Artificial sequence
  Synthetic oligonucleotide
aggaactctgggaatg

SEQ ID NO: 2783 - DNA, 16 bp, Artificial sequence
  Synthetic oligonucleotide
gttgtggaggaactct

SEQ ID NO: 2784 - DNA, 16 bp, Artificial sequence
  Synthetic oligonucleotide
ttgagtgtccgctgct

SEQ ID NO: 2785 - DNA, 16 bp, Artificial sequence
  Synthetic oligonucleotide
agctttgaggttgttt

SEQ ID NO: 2786 - DNA, 16 bp, Artificial sequence
  Synthetic oligonucleotide
tgattgtgtgatgatg

SEQ ID NO: 2787 - DNA, 16 bp, Artificial sequence
  Synthetic oligonucleotide
gatacacaggtgaatt

SEQ ID NO: 2788 - DNA, 16 bp, Artificial sequence
  Synthetic oligonucleotide
gggagtgaggtgagtg

SEQ ID NO: 2789 - DNA, 16 bp, Artificial sequence
  Synthetic oligonucleotide
gccgtgcctacctccc

SEQ ID NO: 2790 - DNA, 16 bp, Artificial sequence
  Synthetic oligonucleotide
cccccccgccgtgcct

SEQ ID NO: 2791 - DNA, 16 bp, Artificial sequence
  Synthetic oligonucleotide
ggctggaatcacggta

SEQ ID NO: 2792 - DNA, 16 bp, Artificial sequence
  Synthetic oligonucleotide
ttcaagttgttcaaag

SEQ ID NO: 2793 - DNA, 16 bp, Artificial sequence
  Synthetic oligonucleotide
tcgatggagtgtggtc

SEQ ID NO: 2794 - DNA, 16 bp, Artificial sequence
  Synthetic oligonucleotide
accttgcaatcctcct

SEQ ID NO: 2795 - DNA, 16 bp, Artificial sequence
  Synthetic oligonucleotide
gtgtgaagtgctccct

SEQ ID NO: 2796 - DNA, 16 bp, Artificial sequence
  Synthetic oligonucleotide
attctaatttggttac

SEQ ID NO: 2797 - DNA, 16 bp, Artificial sequence
  Synthetic oligonucleotide
atagcatgattctaat

SEQ ID NO: 2798 - DNA, 16 bp, Artificial sequence
  Synthetic oligonucleotide
caaatcaatcaaagtt

SEQ ID NO: 2799 - DNA, 16 bp, Artificial sequence
  Synthetic oligonucleotide
acgccccctttgcccc

SEQ ID NO: 2800 - DNA, 16 bp, Artificial sequence
  Synthetic oligonucleotide
attagcagagagggtc

SEQ ID NO: 2801 - DNA, 16 bp, Artificial sequence
  Synthetic oligonucleotide
gcatgaatggccaatg

SEQ ID NO: 2802 - DNA, 16 bp, Artificial sequence
  Synthetic oligonucleotide
tgtaatggctgatgaa

SEQ ID NO: 2803 - DNA, 16 bp, Artificial sequence
  Synthetic oligonucleotide
agtacatatgaggaaa

SEQ ID NO: 2804 - DNA, 16 bp, Artificial sequence
  Synthetic oligonucleotide
accattgcagtacata

SEQ ID NO: 2805 - DNA, 16 bp, Artificial sequence
  Synthetic oligonucleotide
aatgctgatcttgggt

SEQ ID NO: 2806 - DNA, 16 bp, Artificial sequence
  Synthetic oligonucleotide
ggaggaccatggagta

SEQ ID NO: 2807 - DNA, 16 bp, Artificial sequence
  Synthetic oligonucleotide
tttgctggtctctggc

SEQ ID NO: 2808 - DNA, 16 bp, Artificial sequence
  Synthetic oligonucleotide
gacaattgcccctcta

SEQ ID NO: 2809 - DNA, 16 bp, Artificial sequence
  Synthetic oligonucleotide
ttctacgctgtctggt

SEQ ID NO: 2810 - DNA, 16 bp, Artificial sequence
  Synthetic oligonucleotide
tttcggtgaggccctg

SEQ ID NO: 2811 - DNA, 16 bp, Artificial sequence
  Synthetic oligonucleotide
tggatttcaactctgc

SEQ ID NO: 2812 - DNA, 16 bp, Artificial sequence
  Synthetic oligonucleotide
ggaatggtagcccagg

SEQ ID NO: 2813 - DNA, 16 bp, Artificial sequence
  Synthetic oligonucleotide
ctgacatgcctccatc

SEQ ID NO: 2814 - DNA, 16 bp, Artificial sequence
  Synthetic oligonucleotide
cccacaatcaaggttt

SEQ ID NO: 2815 - DNA, 16 bp, Artificial sequence
  Synthetic oligonucleotide
tcagtatgtgtaggcc

SEQ ID NO: 2816 - DNA, 16 bp, Artificial sequence
  Synthetic oligonucleotide
actatgacaagcccct

SEQ ID NO: 2817 - DNA, 16 bp, Artificial sequence
  Synthetic oligonucleotide
ccccgacttgcccaga

SEQ ID NO: 2818 - DNA, 16 bp, Artificial sequence
  Synthetic oligonucleotide
acattctcagacaggg

SEQ ID NO: 2819 - DNA, 16 bp, Artificial sequence
  Synthetic oligonucleotide
catgtggctggcctgt

SEQ ID NO: 2820 - DNA, 16 bp, Artificial sequence
  Synthetic oligonucleotide
ttcttagtctcctggg

SEQ ID NO: 2821 - DNA, 16 bp, Artificial sequence
  Synthetic oligonucleotide
cttttcaggatcctat

SEQ ID NO: 2822 - DNA, 16 bp, Artificial sequence
  Synthetic oligonucleotide
tgctacaccccctgcc

SEQ ID NO: 2823 - DNA, 16 bp, Artificial sequence
  Synthetic oligonucleotide
gagttggattgggtgc

SEQ ID NO: 2824 - DNA, 16 bp, Artificial sequence
  Synthetic oligonucleotide
aagtgacatgggtttt

SEQ ID NO: 2825 - DNA, 16 bp, Artificial sequence
  Synthetic oligonucleotide
ggatgtagtgggcaag

SEQ ID NO: 2826 - DNA, 16 bp, Artificial sequence
  Synthetic oligonucleotide
cggagtcctattttgc

SEQ ID NO: 2827 - DNA, 16 bp, Artificial sequence
  Synthetic oligonucleotide
catagttgcaccccag

SEQ ID NO: 2828 - DNA, 16 bp, Artificial sequence
  Synthetic oligonucleotide
gcggtatgagatactc

SEQ ID NO: 2829 - DNA, 16 bp, Artificial sequence
  Synthetic oligonucleotide
tcccgcccagtgccac

SEQ ID NO: 2830 - DNA, 16 bp, Artificial sequence
  Synthetic oligonucleotide
tgggactacaatacgg

SEQ ID NO: 2831 - DNA, 16 bp, Artificial sequence
  Synthetic oligonucleotide
cctacttggccccagt

SEQ ID NO: 2832 - DNA, 16 bp, Artificial sequence
  Synthetic oligonucleotide
ctcatggagatcgagt

SEQ ID NO: 2833 - DNA, 16 bp, Artificial sequence
  Synthetic oligonucleotide
gtgtctaattcaaata

SEQ ID NO: 2834 - DNA, 16 bp, Artificial sequence
  Synthetic oligonucleotide
gacacctttgaccccc

SEQ ID NO: 2835 - DNA, 16 bp, Artificial sequence
  Synthetic oligonucleotide
attctgcatctttaag

SEQ ID NO: 2836 - DNA, 16 bp, Artificial sequence
  Synthetic oligonucleotide
ttgtaaagctctgtgg

SEQ ID NO: 2837 - DNA, 16 bp, Artificial sequence
  Synthetic oligonucleotide
gagaagcttaaagacg

SEQ ID NO: 2838 - DNA, 16 bp, Artificial sequence
  Synthetic oligonucleotide
tattgggatgaagcct

SEQ ID NO: 2839 - DNA, 16 bp, Artificial sequence
  Synthetic oligonucleotide
ctggctacatgggttc

SEQ ID NO: 2840 - DNA, 16 bp, Artificial sequence
  Synthetic oligonucleotide
tgagttgagaatgggc

SEQ ID NO: 2841 - DNA, 16 bp, Artificial sequence
  Synthetic oligonucleotide
ctggcagtgcctaagt

SEQ ID NO: 2842 - DNA, 16 bp, Artificial sequence
  Synthetic oligonucleotide
tttataccagccctcg

SEQ ID NO: 2843 - DNA, 16 bp, Artificial sequence
  Synthetic oligonucleotide
gaatgtgaggttaggt

SEQ ID NO: 2844 - DNA, 16 bp, Artificial sequence
  Synthetic oligonucleotide
cttagagtcagagggt

SEQ ID NO: 2845 - DNA, 16 bp, Artificial sequence
  Synthetic oligonucleotide
caactcaggatcacag

SEQ ID NO: 2846 - DNA, 16 bp, Artificial sequence
  Synthetic oligonucleotide
tggtcgccatcttgaa

SEQ ID NO: 2847 - DNA, 16 bp, Artificial sequence
  Synthetic oligonucleotide
gtgacctatgtggtta

SEQ ID NO: 2848 - DNA, 16 bp, Artificial sequence
  Synthetic oligonucleotide
acagcatgagccgtat

SEQ ID NO: 2849 - DNA, 16 bp, Artificial sequence
  Synthetic oligonucleotide
gctggagtccagagtg

SEQ ID NO: 2850 - DNA, 16 bp, Artificial sequence
  Synthetic oligonucleotide
gaggttgaaaagaagc

SEQ ID NO: 2851 - DNA, 16 bp, Artificial sequence
  Synthetic oligonucleotide
ggtaggtttagggtca

SEQ ID NO: 2852 - DNA, 16 bp, Artificial sequence
  Synthetic oligonucleotide
tgttacaaggaaaggt

SEQ ID NO: 2853 - DNA, 16 bp, Artificial sequence
  Synthetic oligonucleotide
aatatctggtatcatg

SEQ ID NO: 2854 - DNA, 16 bp, Artificial sequence
  Synthetic oligonucleotide
ttggattcaggaatgg

SEQ ID NO: 2855 - DNA, 16 bp, Artificial sequence
  Synthetic oligonucleotide
ggtaatcagggacagg

SEQ ID NO: 2856 - DNA, 16 bp, Artificial sequence
  Synthetic oligonucleotide
tgtgggaaactgtcac

SEQ ID NO: 2857 - DNA, 16 bp, Artificial sequence
  Synthetic oligonucleotide
ggtccgcctggcagtg

SEQ ID NO: 2858 - DNA, 16 bp, Artificial sequence
  Synthetic oligonucleotide
ggaggaactctgggaa

SEQ ID NO: 2859 - DNA, 16 bp, Artificial sequence
  Synthetic oligonucleotide
gtccgctgcttctctg

SEQ ID NO: 2860 - DNA, 16 bp, Artificial sequence
  Synthetic oligonucleotide
gaggttgtttgagtgt

SEQ ID NO: 2861 - DNA, 16 bp, Artificial sequence
  Synthetic oligonucleotide
atgcagctttgaggtt

SEQ ID NO: 2862 - DNA, 16 bp, Artificial sequence
  Synthetic oligonucleotide
tgtgattgtgtgatga

SEQ ID NO: 2863 - DNA, 16 bp, Artificial sequence
  Synthetic oligonucleotide
gagatacacaggtgaa

SEQ ID NO: 2864 - DNA, 16 bp, Artificial sequence
  Synthetic oligonucleotide
atgggagtgaggtgag

SEQ ID NO: 2865 - DNA, 16 bp, Artificial sequence
  Synthetic oligonucleotide
ccgccgtgcctacctc

SEQ ID NO: 2866 - DNA, 16 bp, Artificial sequence
  Synthetic oligonucleotide
cactgtaccagagggc

SEQ ID NO: 2867 - DNA, 16 bp, Artificial sequence
  Synthetic oligonucleotide
tcaattgatgaattca

SEQ ID NO: 2868 - DNA, 16 bp, Artificial sequence
  Synthetic oligonucleotide
catttcaagttgttca

SEQ ID NO: 2869 - DNA, 16 bp, Artificial sequence
  Synthetic oligonucleotide
gtgtacaaagctctag

SEQ ID NO: 2870 - DNA, 16 bp, Artificial sequence
  Synthetic oligonucleotide
gttcagttaagtgctc

SEQ ID NO: 2871 - DNA, 16 bp, Artificial sequence
  Synthetic oligonucleotide
acagctaaactacggt

SEQ ID NO: 2872 - DNA, 16 bp, Artificial sequence
  Synthetic oligonucleotide
tgattctaatttggtt

SEQ ID NO: 2873 - DNA, 16 bp, Artificial sequence
  Synthetic oligonucleotide
aatcaaagttcatgct

SEQ ID NO: 2874 - DNA, 16 bp, Artificial sequence
  Synthetic oligonucleotide
cccctttgccccagca

SEQ ID NO: 2875 - DNA, 16 bp, Artificial sequence
  Synthetic oligonucleotide
tgcacgccccctttgc

SEQ ID NO: 2876 - DNA, 16 bp, Artificial sequence
  Synthetic oligonucleotide
taggacaaccttttgg

SEQ ID NO: 2877 - DNA, 16 bp, Artificial sequence
  Synthetic oligonucleotide
ttaggagtaaggacat

SEQ ID NO: 2878 - DNA, 16 bp, Artificial sequence
  Synthetic oligonucleotide
tgctatatatgtaatg

SEQ ID NO: 2879 - DNA, 16 bp, Artificial sequence
  Synthetic oligonucleotide
tgcagtacatatgagg

SEQ ID NO: 2880 - DNA, 16 bp, Artificial sequence
  Synthetic oligonucleotide
tcttgggtttattgtg

SEQ ID NO: 2881 - DNA, 16 bp, Artificial sequence
  Synthetic oligonucleotide
tcatcatataccctaa

SEQ ID NO: 2882 - DNA, 16 bp, Artificial sequence
  Synthetic oligonucleotide
cccacatatggagaga

SEQ ID NO: 2883 - DNA, 16 bp, Artificial sequence
  Synthetic oligonucleotide
catttgctggtctctg

SEQ ID NO: 2884 - DNA, 16 bp, Artificial sequence
  Synthetic oligonucleotide
taggtgtctgcagggc

SEQ ID NO: 2885 - DNA, 16 bp, Artificial sequence
  Synthetic oligonucleotide
tggagtagacaagggc

SEQ ID NO: 2886 - DNA, 16 bp, Artificial sequence
  Synthetic oligonucleotide
tcaactctgccgctgc

SEQ ID NO: 2887 - DNA, 16 bp, Artificial sequence
  Synthetic oligonucleotide
cccacctagagtcctg

SEQ ID NO: 2888 - DNA, 16 bp, Artificial sequence
  Synthetic oligonucleotide
catgcctccatcatca

SEQ ID NO: 2889 - DNA, 16 bp, Artificial sequence
  Synthetic oligonucleotide
tgactgacatgcctcc

SEQ ID NO: 2890 - DNA, 16 bp, Artificial sequence
  Synthetic oligonucleotide
cctttggtctgggcct

SEQ ID NO: 2891 - DNA, 16 bp, Artificial sequence
  Synthetic oligonucleotide
cggtcccaaagtctca

SEQ ID NO: 2892 - DNA, 16 bp, Artificial sequence
  Synthetic oligonucleotide
ggtaggtgatgtccat

SEQ ID NO: 2893 - DNA, 16 bp, Artificial sequence
  Synthetic oligonucleotide
cacagcccccgacttg

SEQ ID NO: 2894 - DNA, 16 bp, Artificial sequence
  Synthetic oligonucleotide
tagatacattctcaga

SEQ ID NO: 2895 - DNA, 16 bp, Artificial sequence
  Synthetic oligonucleotide
ggctccgaacaagggc

SEQ ID NO: 2896 - DNA, 16 bp, Artificial sequence
  Synthetic oligonucleotide
cgtagtcccatagtga

SEQ ID NO: 2897 - DNA, 16 bp, Artificial sequence
  Synthetic oligonucleotide
acaatggctccgggcc

SEQ ID NO: 2898 - DNA, 16 bp, Artificial sequence
  Synthetic oligonucleotide
tgtagaagcttctcta

SEQ ID NO: 2899 - DNA, 16 bp, Artificial sequence
  Synthetic oligonucleotide
tgggttttagcttgag

SEQ ID NO: 2900 - DNA, 16 bp, Artificial sequence
  Synthetic oligonucleotide
gagtcaaagtgacatg

SEQ ID NO: 2901 - DNA, 16 bp, Artificial sequence
  Synthetic oligonucleotide
gcagtggagaaggcga

SEQ ID NO: 2902 - DNA, 16 bp, Artificial sequence
  Synthetic oligonucleotide
tctcggactttctcct

SEQ ID NO: 2903 - DNA, 16 bp, Artificial sequence
  Synthetic oligonucleotide
gtggacactcctctgg

SEQ ID NO: 2904 - DNA, 16 bp, Artificial sequence
  Synthetic oligonucleotide
cccagtgccacagtaa

SEQ ID NO: 2905 - DNA, 16 bp, Artificial sequence
  Synthetic oligonucleotide
cctcccgcccagtgcc

SEQ ID NO: 2906 - DNA, 16 bp, Artificial sequence
  Synthetic oligonucleotide
agctatgctcatggga

SEQ ID NO: 2907 - DNA, 16 bp, Artificial sequence
  Synthetic oligonucleotide
ctcacctacttggccc

SEQ ID NO: 2908 - DNA, 16 bp, Artificial sequence
  Synthetic oligonucleotide
atgatcatcccccttt

SEQ ID NO: 2909 - DNA, 16 bp, Artificial sequence
  Synthetic oligonucleotide
ggtacgggctgaggtg

SEQ ID NO: 2910 - DNA, 16 bp, Artificial sequence
  Synthetic oligonucleotide
cgttttttggagggtg

SEQ ID NO: 2911 - DNA, 16 bp, Artificial sequence
  Synthetic oligonucleotide
agctctgtggttttgt

SEQ ID NO: 2912 - DNA, 16 bp, Artificial sequence
  Synthetic oligonucleotide
ctttgtaaagctctgt

SEQ ID NO: 2913 - DNA, 16 bp, Artificial sequence
  Synthetic oligonucleotide
cagagaagcttaaaga

SEQ ID NO: 2914 - DNA, 16 bp, Artificial sequence
  Synthetic oligonucleotide
gaggtcgagagaagct

SEQ ID NO: 2915 - DNA, 16 bp, Artificial sequence
  Synthetic oligonucleotide
agtggaataaggctgg

SEQ ID NO: 2916 - DNA, 16 bp, Artificial sequence
  Synthetic oligonucleotide
tgggagttctctcctc

SEQ ID NO: 2917 - DNA, 16 bp, Artificial sequence
  Synthetic oligonucleotide
gcctggcagtgcctaa

SEQ ID NO: 2918 - DNA, 16 bp, Artificial sequence
  Synthetic oligonucleotide
cttcctttataccagc

SEQ ID NO: 2919 - DNA, 16 bp, Artificial sequence
  Synthetic oligonucleotide
ggacctgaatgtgagg

SEQ ID NO: 2920 - DNA, 16 bp, Artificial sequence
  Synthetic oligonucleotide
ggatcacagtgtttgg

SEQ ID NO: 2921 - DNA, 16 bp, Artificial sequence
  Synthetic oligonucleotide
caggttacatagctgg

SEQ ID NO: 2922 - DNA, 16 bp, Artificial sequence
  Synthetic oligonucleotide
ctctgtggtcgccatc

SEQ ID NO: 2923 - DNA, 16 bp, Artificial sequence
  Synthetic oligonucleotide
tctgtacattcgcatc

SEQ ID NO: 2924 - DNA, 16 bp, Artificial sequence
  Synthetic oligonucleotide
tcggatgatgcctggg

SEQ ID NO: 2925 - DNA, 16 bp, Artificial sequence
  Synthetic oligonucleotide
tagctggagtccagag

SEQ ID NO: 2926 - DNA, 16 bp, Artificial sequence
  Synthetic oligonucleotide
ctcaccgtcaacaccc

SEQ ID NO: 2927 - DNA, 16 bp, Artificial sequence
  Synthetic oligonucleotide
taggctattttatggg

SEQ ID NO: 2928 - DNA, 16 bp, Artificial sequence
  Synthetic oligonucleotide
ggatcaaatgggtgtt

SEQ ID NO: 2929 - DNA, 16 bp, Artificial sequence
  Synthetic oligonucleotide
cagggtttcagttcag

SEQ ID NO: 2930 - DNA, 16 bp, Artificial sequence
  Synthetic oligonucleotide
aggtggttaggctcag

SEQ ID NO: 2931 - DNA, 16 bp, Artificial sequence
  Synthetic oligonucleotide
tgacttggctttaggt

SEQ ID NO: 2932 - DNA, 16 bp, Artificial sequence
  Synthetic oligonucleotide
atgacctaccccgagc

SEQ ID NO: 2933 - DNA, 16 bp, Artificial sequence
  Synthetic oligonucleotide
aagtggactgacagaa

SEQ ID NO: 2934 - DNA, 16 bp, Artificial sequence
  Synthetic oligonucleotide
tggtccgcctggcagt

SEQ ID NO: 2935 - DNA, 16 bp, Artificial sequence
  Synthetic oligonucleotide
tggaggaactctggga

SEQ ID NO: 2936 - DNA, 16 bp, Artificial sequence
  Synthetic oligonucleotide
tgtccgctgcttctct

SEQ ID NO: 2937 - DNA, 16 bp, Artificial sequence
  Synthetic oligonucleotide
tgaggttgtttgagtg

SEQ ID NO: 2938 - DNA, 16 bp, Artificial sequence
  Synthetic oligonucleotide
ttgtgtgatgatgcag

SEQ ID NO: 2939 - DNA, 16 bp, Artificial sequence
  Synthetic oligonucleotide
tgtgtgattgtgtgat

SEQ ID NO: 2940 - DNA, 16 bp, Artificial sequence
  Synthetic oligonucleotide
gtgaggtgagtggcag

SEQ ID NO: 2941 - DNA, 16 bp, Artificial sequence
  Synthetic oligonucleotide
tggatcagggctcagg

SEQ ID NO: 2942 - DNA, 16 bp, Artificial sequence
  Synthetic oligonucleotide
ccccgccgtgcctacc

SEQ ID NO: 2943 - DNA, 16 bp, Artificial sequence
  Synthetic oligonucleotide
acatcccactgtacca

SEQ ID NO: 2944 - DNA, 16 bp, Artificial sequence
  Synthetic oligonucleotide
tatcaattgatgaatt

SEQ ID NO: 2945 - DNA, 16 bp, Artificial sequence
  Synthetic oligonucleotide
agcatttcaagttgtt

SEQ ID NO: 2946 - DNA, 16 bp, Artificial sequence
  Synthetic oligonucleotide
tagggtgaacagaact

SEQ ID NO: 2947 - DNA, 16 bp, Artificial sequence
  Synthetic oligonucleotide
agttcagttaagtgct

SEQ ID NO: 2948 - DNA, 16 bp, Artificial sequence
  Synthetic oligonucleotide
tgaacaacctgtttgc

SEQ ID NO: 2949 - DNA, 16 bp, Artificial sequence
  Synthetic oligonucleotide
atgattctaatttggt

SEQ ID NO: 2950 - DNA, 16 bp, Artificial sequence
  Synthetic oligonucleotide
atcaatcaaagttcat

SEQ ID NO: 2951 - DNA, 16 bp, Artificial sequence
  Synthetic oligonucleotide
ccccctttgccccagc

SEQ ID NO: 2952 - DNA, 16 bp, Artificial sequence
  Synthetic oligonucleotide
atgcacgccccctttg

SEQ ID NO: 2953 - DNA, 16 bp, Artificial sequence
  Synthetic oligonucleotide
ttagcttaagtagagg

SEQ ID NO: 2954 - DNA, 16 bp, Artificial sequence
  Synthetic oligonucleotide
tggctgatgaaaggtt

SEQ ID NO: 2955 - DNA, 16 bp, Artificial sequence
  Synthetic oligonucleotide
ttgctatatatgtaat

SEQ ID NO: 2956 - DNA, 16 bp, Artificial sequence
  Synthetic oligonucleotide
ttgcagtacatatgag

SEQ ID NO: 2957 - DNA, 16 bp, Artificial sequence
  Synthetic oligonucleotide
tgatcttgggtttatt

SEQ ID NO: 2958 - DNA, 16 bp, Artificial sequence
  Synthetic oligonucleotide
gagtatggtttaacaa

SEQ ID NO: 2959 - DNA, 16 bp, Artificial sequence
  Synthetic oligonucleotide
ccctggtataagaaca

SEQ ID NO: 2960 - DNA, 16 bp, Artificial sequence
  Synthetic oligonucleotide
aagaacatttgctggt

SEQ ID NO: 2961 - DNA, 16 bp, Artificial sequence
  Synthetic oligonucleotide
ttaggtgtctgcaggg

SEQ ID NO: 2962 - DNA, 16 bp, Artificial sequence
  Synthetic oligonucleotide
gtggagtagacaaggg

SEQ ID NO: 2963 - DNA, 16 bp, Artificial sequence
  Synthetic oligonucleotide
ttcaactctgccgctg

SEQ ID NO: 2964 - DNA, 16 bp, Artificial sequence
  Synthetic oligonucleotide
ccagggtcccacctag

SEQ ID NO: 2965 - DNA, 16 bp, Artificial sequence
  Synthetic oligonucleotide
acatgcctccatcatc

SEQ ID NO: 2966 - DNA, 16 bp, Artificial sequence
  Synthetic oligonucleotide
ctgactgacatgcctc

SEQ ID NO: 2967 - DNA, 16 bp, Artificial sequence
  Synthetic oligonucleotide
atgtgtaggccagtgt

SEQ ID NO: 2968 - DNA, 16 bp, Artificial sequence
  Synthetic oligonucleotide
tacggtcccaaagtct

SEQ ID NO: 2969 - DNA, 16 bp, Artificial sequence
  Synthetic oligonucleotide
tggtaggtgatgtcca

SEQ ID NO: 2970 - DNA, 16 bp, Artificial sequence
  Synthetic oligonucleotide
ggacacagattatgtt

SEQ ID NO: 2971 - DNA, 16 bp, Artificial sequence
  Synthetic oligonucleotide
atagatacattctcag

SEQ ID NO: 2972 - DNA, 16 bp, Artificial sequence
  Synthetic oligonucleotide
aggctccgaacaaggg

SEQ ID NO: 2973 - DNA, 16 bp, Artificial sequence
  Synthetic oligonucleotide
gatcctataatcctgg

SEQ ID NO: 2974 - DNA, 16 bp, Artificial sequence
  Synthetic oligonucleotide
cacaatggctccgggc

SEQ ID NO: 2975 - DNA, 16 bp, Artificial sequence
  Synthetic oligonucleotide
aatatgtgagtggagg

SEQ ID NO: 2976 - DNA, 16 bp, Artificial sequence
  Synthetic oligonucleotide
acatgggttttagctt

SEQ ID NO: 2977 - DNA, 16 bp, Artificial sequence
  Synthetic oligonucleotide
gagagtcaaagtgaca

SEQ ID NO: 2978 - DNA, 16 bp, Artificial sequence
  Synthetic oligonucleotide
aacagtcctggcaagt

SEQ ID NO: 2979 - DNA, 16 bp, Artificial sequence
  Synthetic oligonucleotide
atcttgccggagctgg

SEQ ID NO: 2980 - DNA, 16 bp, Artificial sequence
  Synthetic oligonucleotide
cgtggacactcctctg

SEQ ID NO: 2981 - DNA, 16 bp, Artificial sequence
  Synthetic oligonucleotide
gcccagtgccacagta

SEQ ID NO: 2982 - DNA, 16 bp, Artificial sequence
  Synthetic oligonucleotide
ccctcccgcccagtgc

SEQ ID NO: 2983 - DNA, 16 bp, Artificial sequence
  Synthetic oligonucleotide
tagctatgctcatggg

SEQ ID NO: 2984 - DNA, 16 bp, Artificial sequence
  Synthetic oligonucleotide
cgagtaactttttaaa

SEQ ID NO: 2985 - DNA, 16 bp, Artificial sequence
  Synthetic oligonucleotide
ctatgatcatccccct

SEQ ID NO: 2986 - DNA, 16 bp, Artificial sequence
  Synthetic oligonucleotide
agtactgcaattcaga

SEQ ID NO: 2987 - DNA, 16 bp, Artificial sequence
  Synthetic oligonucleotide
catctttaaggttctg

SEQ ID NO: 2988 - DNA, 16 bp, Artificial sequence
  Synthetic oligonucleotide
aagctctgtggttttg

SEQ ID NO: 2989 - DNA, 16 bp, Artificial sequence
  Synthetic oligonucleotide
ttttgactagctttgt

SEQ ID NO: 2990 - DNA, 16 bp, Artificial sequence
  Synthetic oligonucleotide
gcagagaagcttaaag

SEQ ID NO: 2991 - DNA, 16 bp, Artificial sequence
  Synthetic oligonucleotide
tgaggtcgagagaagc

SEQ ID NO: 2992 - DNA, 16 bp, Artificial sequence
  Synthetic oligonucleotide
aacagtggaataaggc

SEQ ID NO: 2993 - DNA, 16 bp, Artificial sequence
  Synthetic oligonucleotide
ctctgggagttctctc

SEQ ID NO: 2994 - DNA, 16 bp, Artificial sequence
  Synthetic oligonucleotide
cgcctggcagtgccta

SEQ ID NO: 2995 - DNA, 16 bp, Artificial sequence
  Synthetic oligonucleotide
ccttcctttataccag

SEQ ID NO: 2996 - DNA, 16 bp, Artificial sequence
  Synthetic oligonucleotide
tttgtaagtagaaggg

SEQ ID NO: 2997 - DNA, 16 bp, Artificial sequence
  Synthetic oligonucleotide
aggatcacagtgtttg

SEQ ID NO: 2998 - DNA, 16 bp, Artificial sequence
  Synthetic oligonucleotide
tcgccatcttgaaatc

SEQ ID NO: 2999 - DNA, 16 bp, Artificial sequence
  Synthetic oligonucleotide
gctctgtggtcgccat

SEQ ID NO: 3000 - DNA, 16 bp, Artificial sequence
  Synthetic oligonucleotide
gtcacctaaacccccc

SEQ ID NO: 3001 - DNA, 16 bp, Artificial sequence
  Synthetic oligonucleotide
ccgtgtagtgcaagga

SEQ ID NO: 3002 - DNA, 16 bp, Artificial sequence
  Synthetic oligonucleotide
agtagctggagtccag

SEQ ID NO: 3003 - DNA, 16 bp, Artificial sequence
  Synthetic oligonucleotide
ttggatttgcggacag

SEQ ID NO: 3004 - DNA, 16 bp, Artificial sequence
  Synthetic oligonucleotide
ggaatggtgcccagtt

SEQ ID NO: 3005 - DNA, 16 bp, Artificial sequence
  Synthetic oligonucleotide
atctggtatcatgtag

SEQ ID NO: 3006 - DNA, 16 bp, Artificial sequence
  Synthetic oligonucleotide
aggctatcagtcagga

SEQ ID NO: 3007 - DNA, 16 bp, Artificial sequence
  Synthetic oligonucleotide
atggttaggtggttag

SEQ ID NO: 3008 - DNA, 16 bp, Artificial sequence
  Synthetic oligonucleotide
gatgggatgacttggc

SEQ ID NO: 3009 - DNA, 16 bp, Artificial sequence
  Synthetic oligonucleotide
gctatgacctaccccg

SEQ ID NO: 3010 - DNA, 16 bp, Artificial sequence
  Synthetic oligonucleotide
gcttggtgaagtggac

SEQ ID NO: 3011 - DNA, 16 bp, Artificial sequence
  Synthetic oligonucleotide
atggtccgcctggcag

SEQ ID NO: 3012 - DNA, 16 bp, Artificial sequence
  Synthetic oligonucleotide
tgtggaggaactctgg

SEQ ID NO: 3013 - DNA, 16 bp, Artificial sequence
  Synthetic oligonucleotide
agtgtccgctgcttct

SEQ ID NO: 3014 - DNA, 16 bp, Artificial sequence
  Synthetic oligonucleotide
tttgaggttgtttgag

SEQ ID NO: 3015 - DNA, 16 bp, Artificial sequence
  Synthetic oligonucleotide
attgtgtgatgatgca

SEQ ID NO: 3016 - DNA, 16 bp, Artificial sequence
  Synthetic oligonucleotide
atcctgagggtactga

SEQ ID NO: 3017 - DNA, 16 bp, Artificial sequence
  Synthetic oligonucleotide
agtgaggtgagtggca

SEQ ID NO: 3018 - DNA, 16 bp, Artificial sequence
  Synthetic oligonucleotide
cgtgcctacctccctg

SEQ ID NO: 3019 - DNA, 16 bp, Artificial sequence
  Synthetic oligonucleotide
cccccgccgtgcctac

SEQ ID NO: 3020 - DNA, 16 bp, Artificial sequence
  Synthetic oligonucleotide
gggtacatcccactgt

SEQ ID NO: 3021 - DNA, 16 bp, Artificial sequence
  Synthetic oligonucleotide
gtatcaattgatgaat

SEQ ID NO: 3022 - DNA, 16 bp, Artificial sequence
  Synthetic oligonucleotide
cagcatttcaagttgt

SEQ ID NO: 3023 - DNA, 16 bp, Artificial sequence
  Synthetic oligonucleotide
ctgctactagggtgaa

SEQ ID NO: 3024 - DNA, 16 bp, Artificial sequence
  Synthetic oligonucleotide
aagttcagttaagtgc

SEQ ID NO: 3025 - DNA, 16 bp, Artificial sequence
  Synthetic oligonucleotide
tactttgtgccaaacg

SEQ ID NO: 3026 - DNA, 16 bp, Artificial sequence
  Synthetic oligonucleotide
agcatgattctaattt

SEQ ID NO: 3027 - DNA, 16 bp, Artificial sequence
  Synthetic oligonucleotide
aatcaatcaaagttca

SEQ ID NO: 3028 - DNA, 16 bp, Artificial sequence
  Synthetic oligonucleotide
gccccctttgccccag

SEQ ID NO: 3029 - DNA, 16 bp, Artificial sequence
  Synthetic oligonucleotide
aatgcacgcccccttt

SEQ ID NO: 3030 - DNA, 16 bp, Artificial sequence
  Synthetic oligonucleotide
agggttagcttaagta

SEQ ID NO: 3031 - DNA, 16 bp, Artificial sequence
  Synthetic oligonucleotide
aatggctgatgaaagg

SEQ ID NO: 3032 - DNA, 16 bp, Artificial sequence
  Synthetic oligonucleotide
gcaaatgatgaattgg

SEQ ID NO: 3033 - DNA, 16 bp, Artificial sequence
  Synthetic oligonucleotide
attgcagtacatatga

SEQ ID NO: 3034 - DNA, 16 bp, Artificial sequence
  Synthetic oligonucleotide
tgctgatcttgggttt

SEQ ID NO: 3035 - DNA, 16 bp, Artificial sequence
  Synthetic oligonucleotide
atggagtatggtttaa

SEQ ID NO: 3036 - DNA, 16 bp, Artificial sequence
  Synthetic oligonucleotide
agggacacccatggct

SEQ ID NO: 3037 - DNA, 16 bp, Artificial sequence
  Synthetic oligonucleotide
taagaacatttgctgg

SEQ ID NO: 3038 - DNA, 16 bp, Artificial sequence
  Synthetic oligonucleotide
taagtcattaggtgtc

SEQ ID NO: 3039 - DNA, 16 bp, Artificial sequence
  Synthetic oligonucleotide
ttctacactgagcacg

SEQ ID NO: 3040 - DNA, 16 bp, Artificial sequence
  Synthetic oligonucleotide
tttcaactctgccgct

SEQ ID NO: 3041 - DNA, 16 bp, Artificial sequence
  Synthetic oligonucleotide
accagggtcccaccta

SEQ ID NO: 3042 - DNA, 16 bp, Artificial sequence
  Synthetic oligonucleotide
gacatgcctccatcat

SEQ ID NO: 3043 - DNA, 16 bp, Artificial sequence
  Synthetic oligonucleotide
actgactgacatgcct

SEQ ID NO: 3044 - DNA, 16 bp, Artificial sequence
  Synthetic oligonucleotide
tatgtgtaggccagtg

SEQ ID NO: 3045 - DNA, 16 bp, Artificial sequence
  Synthetic oligonucleotide
tgaagacctggccctt

SEQ ID NO: 3046 - DNA, 16 bp, Artificial sequence
  Synthetic oligonucleotide
atgtggtaggtgatgt

SEQ ID NO: 3047 - DNA, 16 bp, Artificial sequence
  Synthetic oligonucleotide
aggacctagagggccg

SEQ ID NO: 3048 - DNA, 16 bp, Artificial sequence
  Synthetic oligonucleotide
aaagcatagatacatt

SEQ ID NO: 3049 - DNA, 16 bp, Artificial sequence
  Synthetic oligonucleotide
gaggctccgaacaagg

SEQ ID NO: 3050 - DNA, 16 bp, Artificial sequence
  Synthetic oligonucleotide
ggatcctataatcctg

SEQ ID NO: 3051 - DNA, 16 bp, Artificial sequence
  Synthetic oligonucleotide
tccacaatggctccgg

SEQ ID NO: 3052 - DNA, 16 bp, Artificial sequence
  Synthetic oligonucleotide
gtgtagatagacatga

SEQ ID NO: 3053 - DNA, 16 bp, Artificial sequence
  Synthetic oligonucleotide
gacatgggttttagct

SEQ ID NO: 3054 - DNA, 16 bp, Artificial sequence
  Synthetic oligonucleotide
ggagagtcaaagtgac

SEQ ID NO: 3055 - DNA, 16 bp, Artificial sequence
  Synthetic oligonucleotide
tattttgccccagtga

SEQ ID NO: 3056 - DNA, 16 bp, Artificial sequence
  Synthetic oligonucleotide
gcaatggttgtttccc

SEQ ID NO: 3057 - DNA, 16 bp, Artificial sequence
  Synthetic oligonucleotide
gagatactcgaccacc

SEQ ID NO: 3058 - DNA, 16 bp, Artificial sequence
  Synthetic oligonucleotide
cgcccagtgccacagt

SEQ ID NO: 3059 - DNA, 16 bp, Artificial sequence
  Synthetic oligonucleotide
ggattttcttggccct

SEQ ID NO: 3060 - DNA, 16 bp, Artificial sequence
  Synthetic oligonucleotide
catagctatgctcatg

SEQ ID NO: 3061 - DNA, 16 bp, Artificial sequence
  Synthetic oligonucleotide
catggagatcgagtaa

SEQ ID NO: 3062 - DNA, 16 bp, Artificial sequence
  Synthetic oligonucleotide
agatgctatgatcatc

SEQ ID NO: 3063 - DNA, 16 bp, Artificial sequence
  Synthetic oligonucleotide
acctttgacccccaga

SEQ ID NO: 3064 - DNA, 16 bp, Artificial sequence
  Synthetic oligonucleotide
tctgcatctttaaggt

SEQ ID NO: 3065 - DNA, 16 bp, Artificial sequence
  Synthetic oligonucleotide
aaagctctgtggtttt

SEQ ID NO: 3066 - DNA, 16 bp, Artificial sequence
  Synthetic oligonucleotide
cattttgactagcttt

SEQ ID NO: 3067 - DNA, 16 bp, Artificial sequence
  Synthetic oligonucleotide
acagggcacctatgga

SEQ ID NO: 3068 - DNA, 16 bp, Artificial sequence
  Synthetic oligonucleotide
cgtttcttattataca

SEQ ID NO: 3069 - DNA, 16 bp, Artificial sequence
  Synthetic oligonucleotide
ctttgggaacagtgga

SEQ ID NO: 3070 - DNA, 16 bp, Artificial sequence
  Synthetic oligonucleotide
ccctctgggagttctc

SEQ ID NO: 3071 - DNA, 16 bp, Artificial sequence
  Synthetic oligonucleotide
ccgcctggcagtgcct

SEQ ID NO: 3072 - DNA, 16 bp, Artificial sequence
  Synthetic oligonucleotide
tccttcctttatacca

SEQ ID NO: 3073 - DNA, 16 bp, Artificial sequence
  Synthetic oligonucleotide
gagggtttgtaagtag

SEQ ID NO: 3074 - DNA, 16 bp, Artificial sequence
  Synthetic oligonucleotide
caggatcacagtgttt

SEQ ID NO: 3075 - DNA, 16 bp, Artificial sequence
  Synthetic oligonucleotide
gtcgccatcttgaaat

SEQ ID NO: 3076 - DNA, 16 bp, Artificial sequence
  Synthetic oligonucleotide
tgctctgtggtcgcca

SEQ ID NO: 3077 - DNA, 16 bp, Artificial sequence
  Synthetic oligonucleotide
accacccaactgtgac

SEQ ID NO: 3078 - DNA, 16 bp, Artificial sequence
  Synthetic oligonucleotide
tgagtggcggcagctg

SEQ ID NO: 3079 - DNA, 16 bp, Artificial sequence
  Synthetic oligonucleotide
atagtagctggagtcc

SEQ ID NO: 3080 - DNA, 16 bp, Artificial sequence
  Synthetic oligonucleotide
tggtggtttaggtttg

SEQ ID NO: 3081 - DNA, 16 bp, Artificial sequence
  Synthetic oligonucleotide
acaaggaaaggttggg

SEQ ID NO: 3082 - DNA, 16 bp, Artificial sequence
  Synthetic oligonucleotide
tatctggtatcatgta

SEQ ID NO: 3083 - DNA, 16 bp, Artificial sequence
  Synthetic oligonucleotide
gaggctatcagtcagg

SEQ ID NO: 3084 - DNA, 16 bp, Artificial sequence
  Synthetic oligonucleotide
acatggttaggtggtt

SEQ ID NO: 3085 - DNA, 16 bp, Artificial sequence
  Synthetic oligonucleotide
ggtgaagtgtcgggtt

SEQ ID NO: 3086 - DNA, 16 bp, Artificial sequence
  Synthetic oligonucleotide
ggctatgacctacccc

SEQ ID NO: 3087 - DNA, 16 bp, Artificial sequence
  Synthetic oligonucleotide
ggccccgcctcgaaga

SEQ ID NO: 3088 - DNA, 16 bp, Artificial sequence
  Synthetic oligonucleotide
ggaactctgggaatgt

SEQ ID NO: 3089 - DNA, 16 bp, Artificial sequence
  Synthetic oligonucleotide
ttgtggaggaactctg

SEQ ID NO: 3090 - DNA, 16 bp, Artificial sequence
  Synthetic oligonucleotide
tgagtgtccgctgctt

SEQ ID NO: 3091 - DNA, 16 bp, Artificial sequence
  Synthetic oligonucleotide
ctttgaggttgtttga

SEQ ID NO: 3092 - DNA, 16 bp, Artificial sequence
  Synthetic oligonucleotide
gattgtgtgatgatgc

SEQ ID NO: 3093 - DNA, 16 bp, Artificial sequence
  Synthetic oligonucleotide
gatcctgagggtactg

SEQ ID NO: 3094 - DNA, 16 bp, Artificial sequence
  Synthetic oligonucleotide
ggagtgaggtgagtgg

SEQ ID NO: 3095 - DNA, 16 bp, Artificial sequence
  Synthetic oligonucleotide
ccgtgcctacctccct

SEQ ID NO: 3096 - DNA, 16 bp, Artificial sequence
  Synthetic oligonucleotide
ccccccgccgtgccta

SEQ ID NO: 3097 - DNA, 16 bp, Artificial sequence
  Synthetic oligonucleotide
ctgggtacatcccact

SEQ ID NO: 3098 - DNA, 16 bp, Artificial sequence
  Synthetic oligonucleotide
tcaagttgttcaaagc

SEQ ID NO: 3099 - DNA, 16 bp, Artificial sequence
  Synthetic oligonucleotide
gcaagacagggtgagc

SEQ ID NO: 3100 - DNA, 16 bp, Artificial sequence
  Synthetic oligonucleotide
ttgcaatcctcctgct

SEQ ID NO: 3101 - DNA, 16 bp, Artificial sequence
  Synthetic oligonucleotide
aaagttcagttaagtg

SEQ ID NO: 3102 - DNA, 16 bp, Artificial sequence
  Synthetic oligonucleotide
ggttacagaaatacta

SEQ ID NO: 3103 - DNA, 16 bp, Artificial sequence
  Synthetic oligonucleotide
tagcatgattctaatt

SEQ ID NO: 3104 - DNA, 16 bp, Artificial sequence
  Synthetic oligonucleotide
aaatcaatcaaagttc

SEQ ID NO: 3105 - DNA, 16 bp, Artificial sequence
  Synthetic oligonucleotide
cgccccctttgcccca

SEQ ID NO: 3106 - DNA, 16 bp, Artificial sequence
  Synthetic oligonucleotide
gagggtcataaacttt

SEQ ID NO: 3107 - DNA, 16 bp, Artificial sequence
  Synthetic oligonucleotide
ctcacctagggttagc

SEQ ID NO: 3108 - DNA, 16 bp, Artificial sequence
  Synthetic oligonucleotide
taatggctgatgaaag

SEQ ID NO: 3109 - DNA, 16 bp, Artificial sequence
  Synthetic oligonucleotide
gactgtataaaaccat

SEQ ID NO: 3110 - DNA, 16 bp, Artificial sequence
  Synthetic oligonucleotide
ccattgcagtacatat

SEQ ID NO: 3111 - DNA, 16 bp, Artificial sequence
  Synthetic oligonucleotide
atgctgatcttgggtt

SEQ ID NO: 3112 - DNA, 16 bp, Artificial sequence
  Synthetic oligonucleotide
accatggagtatggtt

SEQ ID NO: 3113 - DNA, 16 bp, Artificial sequence
  Synthetic oligonucleotide
ttgctggtctctggct

SEQ ID NO: 3114 - DNA, 16 bp, Artificial sequence
  Synthetic oligonucleotide
atgcatggagagccag

SEQ ID NO: 3115 - DNA, 16 bp, Artificial sequence
  Synthetic oligonucleotide
tacgctgtctggttaa

SEQ ID NO: 3116 - DNA, 16 bp, Artificial sequence
  Synthetic oligonucleotide
ttcggtgaggccctga

SEQ ID NO: 3117 - DNA, 16 bp, Artificial sequence
  Synthetic oligonucleotide
atttcaactctgccgc

SEQ ID NO: 3118 - DNA, 16 bp, Artificial sequence
  Synthetic oligonucleotide
aatggtagcccaggtt

SEQ ID NO: 3119 - DNA, 16 bp, Artificial sequence
  Synthetic oligonucleotide
tgacatgcctccatca

SEQ ID NO: 3120 - DNA, 16 bp, Artificial sequence
  Synthetic oligonucleotide
acaatcaaggttttcg

SEQ ID NO: 3121 - DNA, 16 bp, Artificial sequence
  Synthetic oligonucleotide
cagtatgtgtaggcca

SEQ ID NO: 3122 - DNA, 16 bp, Artificial sequence
  Synthetic oligonucleotide
agctctgaagacctgg

SEQ ID NO: 3123 - DNA, 16 bp, Artificial sequence
  Synthetic oligonucleotide
ccgacttgcccagatt

SEQ ID NO: 3124 - DNA, 16 bp, Artificial sequence
  Synthetic oligonucleotide
ggacatggagatgatc

SEQ ID NO: 3125 - DNA, 16 bp, Artificial sequence
  Synthetic oligonucleotide
caaagcatagatacat

SEQ ID NO: 3126 - DNA, 16 bp, Artificial sequence
  Synthetic oligonucleotide
tctgtggaggctccga

SEQ ID NO: 3127 - DNA, 16 bp, Artificial sequence
  Synthetic oligonucleotide
tcaggatcctataatc

SEQ ID NO: 3128 - DNA, 16 bp, Artificial sequence
  Synthetic oligonucleotide
ctccacaatggctccg

SEQ ID NO: 3129 - DNA, 16 bp, Artificial sequence
  Synthetic oligonucleotide
aggtgtagatagacat

SEQ ID NO: 3130 - DNA, 16 bp, Artificial sequence
  Synthetic oligonucleotide
tgacatgggttttagc

SEQ ID NO: 3131 - DNA, 16 bp, Artificial sequence
  Synthetic oligonucleotide
gatgtagtgggcaaga

SEQ ID NO: 3132 - DNA, 16 bp, Artificial sequence
  Synthetic oligonucleotide
ggagtcctattttgcc

SEQ ID NO: 3133 - DNA, 16 bp, Artificial sequence
  Synthetic oligonucleotide
aggtacatgtacatac

SEQ ID NO: 3134 - DNA, 16 bp, Artificial sequence
  Synthetic oligonucleotide
cggtatgagatactcg

SEQ ID NO: 3135 - DNA, 16 bp, Artificial sequence
  Synthetic oligonucleotide
ccgcccagtgccacag

SEQ ID NO: 3136 - DNA, 16 bp, Artificial sequence
  Synthetic oligonucleotide
gggactacaatacggc

SEQ ID NO: 3137 - DNA, 16 bp, Artificial sequence
  Synthetic oligonucleotide
cacatagctatgctca

SEQ ID NO: 3138 - DNA, 16 bp, Artificial sequence
  Synthetic oligonucleotide
tcatggagatcgagta

SEQ ID NO: 3139 - DNA, 16 bp, Artificial sequence
  Synthetic oligonucleotide
tagatgctatgatcat

SEQ ID NO: 3140 - DNA, 16 bp, Artificial sequence
  Synthetic oligonucleotide
cacctttgacccccag

SEQ ID NO: 3141 - DNA, 16 bp, Artificial sequence
  Synthetic oligonucleotide
ttctgcatctttaagg

SEQ ID NO: 3142 - DNA, 16 bp, Artificial sequence
  Synthetic oligonucleotide
taaagctctgtggttt

SEQ ID NO: 3143 - DNA, 16 bp, Artificial sequence
  Synthetic oligonucleotide
tgctgacattttgact

SEQ ID NO: 3144 - DNA, 16 bp, Artificial sequence
  Synthetic oligonucleotide
ccggtagactggcaca

SEQ ID NO: 3145 - DNA, 16 bp, Artificial sequence
  Synthetic oligonucleotide
ggctacatgggttcaa

SEQ ID NO: 3146 - DNA, 16 bp, Artificial sequence
  Synthetic oligonucleotide
aagcattctgggtgga

SEQ ID NO: 3147 - DNA, 16 bp, Artificial sequence
  Synthetic oligonucleotide
tgcaggtgaccacgac

SEQ ID NO: 3148 - DNA, 16 bp, Artificial sequence
  Synthetic oligonucleotide
cagaaggttttgcgca

SEQ ID NO: 3149 - DNA, 16 bp, Artificial sequence
  Synthetic oligonucleotide
aatgtgaggttaggtt

SEQ ID NO: 3150 - DNA, 16 bp, Artificial sequence
  Synthetic oligonucleotide
ttagagtcagagggtt

SEQ ID NO: 3151 - DNA, 16 bp, Artificial sequence
  Synthetic oligonucleotide
aactcaggatcacagt

SEQ ID NO: 3152 - DNA, 16 bp, Artificial sequence
  Synthetic oligonucleotide
ggtcgccatcttgaaa

SEQ ID NO: 3153 - DNA, 16 bp, Artificial sequence
  Synthetic oligonucleotide
acctatgtggttatgt

SEQ ID NO: 3154 - DNA, 16 bp, Artificial sequence
  Synthetic oligonucleotide
ccactgatgctgggac

SEQ ID NO: 3155 - DNA, 16 bp, Artificial sequence
  Synthetic oligonucleotide
gacactcgagaccata

SEQ ID NO: 3156 - DNA, 16 bp, Artificial sequence
  Synthetic oligonucleotide
gtaacttgcacaccaa

SEQ ID NO: 3157 - DNA, 16 bp, Artificial sequence
  Synthetic oligonucleotide
cctggatggtggttta

SEQ ID NO: 3158 - DNA, 16 bp, Artificial sequence
  Synthetic oligonucleotide
gttacaaggaaaggtt

SEQ ID NO: 3159 - DNA, 16 bp, Artificial sequence
  Synthetic oligonucleotide
atatctggtatcatgt

SEQ ID NO: 3160 - DNA, 16 bp, Artificial sequence
  Synthetic oligonucleotide
tgattgcagtgaggct

SEQ ID NO: 3161 - DNA, 16 bp, Artificial sequence
  Synthetic oligonucleotide
agggacatggttaggt

SEQ ID NO: 3162 - DNA, 16 bp, Artificial sequence
  Synthetic oligonucleotide
gtaatcagggacagga

SEQ ID NO: 3163 - DNA, 16 bp, Artificial sequence
  Synthetic oligonucleotide
gcacattccccaaact

SEQ ID NO: 3164 - DNA, 16 bp, Artificial sequence
  Synthetic oligonucleotide
aactttgcttttatac

SEQ ID NO: 3165 - DNA, 16 bp, Artificial sequence
  Synthetic oligonucleotide
gtccgcctggcagtgc

SEQ ID NO: 3166 - DNA, 16 bp, Artificial sequence
  Synthetic oligonucleotide
gaggaactctgggaat

SEQ ID NO: 3167 - DNA, 16 bp, Artificial sequence
  Synthetic oligonucleotide
tgttgtggaggaactc

SEQ ID NO: 3168 - DNA, 16 bp, Artificial sequence
  Synthetic oligonucleotide
gttgtttgagtgtact

SEQ ID NO: 3169 - DNA, 16 bp, Artificial sequence
  Synthetic oligonucleotide
gcagctttgaggttgt

SEQ ID NO: 3170 - DNA, 16 bp, Artificial sequence
  Synthetic oligonucleotide
gtgattgtgtgatgat

SEQ ID NO: 3171 - DNA, 16 bp, Artificial sequence
  Synthetic oligonucleotide
agatacacaggtgaat

SEQ ID NO: 3172 - DNA, 16 bp, Artificial sequence
  Synthetic oligonucleotide
tgggagtgaggtgagt

SEQ ID NO: 3173 - DNA, 16 bp, Artificial sequence
  Synthetic oligonucleotide
cgccgtgcctacctcc

SEQ ID NO: 3174 - DNA, 16 bp, Artificial sequence
  Synthetic oligonucleotide
actgtaccagagggcc

SEQ ID NO: 3175 - DNA, 16 bp, Artificial sequence
  Synthetic oligonucleotide
caattgatgaattcat

SEQ ID NO: 3176 - DNA, 16 bp, Artificial sequence
  Synthetic oligonucleotide
atttcaagttgttcaa

SEQ ID NO: 3177 - DNA, 16 bp, Artificial sequence
  Synthetic oligonucleotide
tgtacaaagctctagg

SEQ ID NO: 3178 - DNA, 16 bp, Artificial sequence
  Synthetic oligonucleotide
taagtgctcagcttgc

SEQ ID NO: 3179 - DNA, 16 bp, Artificial sequence
  Synthetic oligonucleotide
acaatggtgtgaagtg

SEQ ID NO: 3180 - DNA, 16 bp, Artificial sequence
  Synthetic oligonucleotide
gattctaatttggtta

SEQ ID NO: 3181 - DNA, 16 bp, Artificial sequence
  Synthetic oligonucleotide
tatagcatgattctaa

SEQ ID NO: 3182 - DNA, 16 bp, Artificial sequence
  Synthetic oligonucleotide
ccaacaatcggcactt

SEQ ID NO: 3183 - DNA, 16 bp, Artificial sequence
  Synthetic oligonucleotide
gcacgccccctttgcc

SEQ ID NO: 3184 - DNA, 16 bp, Artificial sequence
  Synthetic oligonucleotide
acaaccttttggaagg

SEQ ID NO: 3185 - DNA, 16 bp, Artificial sequence
  Synthetic oligonucleotide
aaaagcatgaatggcc

SEQ ID NO: 3186 - DNA, 16 bp, Artificial sequence
  Synthetic oligonucleotide
tatatatgtaatggct

SEQ ID NO: 3187 - DNA, 16 bp, Artificial sequence
  Synthetic oligonucleotide
gcagtacatatgagga

SEQ ID NO: 3188 - DNA, 16 bp, Artificial sequence
  Synthetic oligonucleotide
ggtactattataacca

SEQ ID NO: 3189 - DNA, 16 bp, Artificial sequence
  Synthetic oligonucleotide
taagttttaacaccta

SEQ ID NO: 3190 - DNA, 16 bp, Artificial sequence
  Synthetic oligonucleotide
gagaactgaatttgtg

SEQ ID NO: 3191 - DNA, 16 bp, Artificial sequence
  Synthetic oligonucleotide
atttgctggtctctgg

SEQ ID NO: 3192 - DNA, 16 bp, Artificial sequence
  Synthetic oligonucleotide
tcaagttgacaattgc

SEQ ID NO: 3193 - DNA, 16 bp, Artificial sequence
  Synthetic oligonucleotide
ggagtagacaagggcc

SEQ ID NO: 3194 - DNA, 16 bp, Artificial sequence
  Synthetic oligonucleotide
gccgctgcatttcggt

SEQ ID NO: 3195 - DNA, 16 bp, Artificial sequence
  Synthetic oligonucleotide
ttggatttcaactctg

SEQ ID NO: 3196 - DNA, 16 bp, Artificial sequence
  Synthetic oligonucleotide
ctgacctatggagtcc

SEQ ID NO: 3197 - DNA, 16 bp, Artificial sequence
  Synthetic oligonucleotide
gactgacatgcctcca

SEQ ID NO: 3198 - DNA, 16 bp, Artificial sequence
  Synthetic oligonucleotide
gccccacaatcaaggt

SEQ ID NO: 3199 - DNA, 16 bp, Artificial sequence
  Synthetic oligonucleotide
cccaaagtctcagtat

SEQ ID NO: 3200 - DNA, 16 bp, Artificial sequence
  Synthetic oligonucleotide
gccactatgacaagcc

SEQ ID NO: 3201 - DNA, 16 bp, Artificial sequence
  Synthetic oligonucleotide
acagcccccgacttgc

SEQ ID NO: 3202 - DNA, 16 bp, Artificial sequence
  Synthetic oligonucleotide
agatacattctcagac

SEQ ID NO: 3203 - DNA, 16 bp, Artificial sequence
  Synthetic oligonucleotide
gatgttttccaccact

SEQ ID NO: 3204 - DNA, 16 bp, Artificial sequence
  Synthetic oligonucleotide
gggtggttgtcagagc

SEQ ID NO: 3205 - DNA, 16 bp, Artificial sequence
  Synthetic oligonucleotide
tgagggaagcactggc

SEQ ID NO: 3206 - DNA, 16 bp, Artificial sequence
  Synthetic oligonucleotide
atgctacaccccctgc

SEQ ID NO: 3207 - DNA, 16 bp, Artificial sequence
  Synthetic oligonucleotide
ggagttggattgggtg

SEQ ID NO: 3208 - DNA, 16 bp, Artificial sequence
  Synthetic oligonucleotide
gtcaaagtgacatggg

SEQ ID NO: 3209 - DNA, 16 bp, Artificial sequence
  Synthetic oligonucleotide
tcaggagcagtgctag

SEQ ID NO: 3210 - DNA, 16 bp, Artificial sequence
  Synthetic oligonucleotide
tcggagtcctattttg

SEQ ID NO: 3211 - DNA, 16 bp, Artificial sequence
  Synthetic oligonucleotide
ctctggtcaaagcagg

SEQ ID NO: 3212 - DNA, 16 bp, Artificial sequence
  Synthetic oligonucleotide
ccagtgccacagtaaa

SEQ ID NO: 3213 - DNA, 16 bp, Artificial sequence
  Synthetic oligonucleotide
ctcccgcccagtgcca

SEQ ID NO: 3214 - DNA, 16 bp, Artificial sequence
  Synthetic oligonucleotide
atgggactacaatacg

SEQ ID NO: 3215 - DNA, 16 bp, Artificial sequence
  Synthetic oligonucleotide
tcacctacttggcccc

SEQ ID NO: 3216 - DNA, 16 bp, Artificial sequence
  Synthetic oligonucleotide
tgatcatccccctttt

SEQ ID NO: 3217 - DNA, 16 bp, Artificial sequence
  Synthetic oligonucleotide
ctgtggttcagcctga

SEQ ID NO: 3218 - DNA, 16 bp, Artificial sequence
  Synthetic oligonucleotide
gtggagtttccaagcc

SEQ ID NO: 3219 - DNA, 16 bp, Artificial sequence
  Synthetic oligonucleotide
gctctgtggttttgtg

SEQ ID NO: 3220 - DNA, 16 bp, Artificial sequence
  Synthetic oligonucleotide
tttgtaaagctctgtg

SEQ ID NO: 3221 - DNA, 16 bp, Artificial sequence
  Synthetic oligonucleotide
agagaagcttaaagac

SEQ ID NO: 3222 - DNA, 16 bp, Artificial sequence
  Synthetic oligonucleotide
gcatcttactacttat

SEQ ID NO: 3223 - DNA, 16 bp, Artificial sequence
  Synthetic oligonucleotide
gcagattctagagcct

SEQ ID NO: 3224 - DNA, 16 bp, Artificial sequence
  Synthetic oligonucleotide
atgttggaagtgtggt

SEQ ID NO: 3225 - DNA, 16 bp, Artificial sequence
  Synthetic oligonucleotide
cctggcagtgcctaag

SEQ ID NO: 3226 - DNA, 16 bp, Artificial sequence
  Synthetic oligonucleotide
ttcctttataccagcc

SEQ ID NO: 3227 - DNA, 16 bp, Artificial sequence
  Synthetic oligonucleotide
tgaatgtgaggttagg

SEQ ID NO: 3228 - DNA, 16 bp, Artificial sequence
  Synthetic oligonucleotide
ggatcttagagtcaga

SEQ ID NO: 3229 - DNA, 16 bp, Artificial sequence
  Synthetic oligonucleotide
atagctggtcctgctg

SEQ ID NO: 3230 - DNA, 16 bp, Artificial sequence
  Synthetic oligonucleotide
tgtggtcgccatcttg

SEQ ID NO: 3231 - DNA, 16 bp, Artificial sequence
  Synthetic oligonucleotide
ctgtacattcgcatca

SEQ ID NO: 3232 - DNA, 16 bp, Artificial sequence
  Synthetic oligonucleotide
gaggtggaatcccaca

SEQ ID NO: 3233 - DNA, 16 bp, Artificial sequence
  Synthetic oligonucleotide
agctggagtccagagt

SEQ ID NO: 3234 - DNA, 16 bp, Artificial sequence
  Synthetic oligonucleotide
ttgcaccacttctgcc

SEQ ID NO: 3235 - DNA, 16 bp, Artificial sequence
  Synthetic oligonucleotide
gctattttatgggtcc

SEQ ID NO: 3236 - DNA, 16 bp, Artificial sequence
  Synthetic oligonucleotide
aatgggtgttacaagg

SEQ ID NO: 3237 - DNA, 16 bp, Artificial sequence
  Synthetic oligonucleotide
ggaatatctggtatca

SEQ ID NO: 3238 - DNA, 16 bp, Artificial sequence
  Synthetic oligonucleotide
gtggttaggctcaggg

SEQ ID NO: 3239 - DNA, 16 bp, Artificial sequence
  Synthetic oligonucleotide
tggtttgaattatcga

SEQ ID NO: 3240 - DNA, 16 bp, Artificial sequence
  Synthetic oligonucleotide
ggcaggtaatcaggga

SEQ ID NO: 3241 - DNA, 16 bp, Artificial sequence
  Synthetic oligonucleotide
caccgttgagagctgc

SEQ ID NO: 3242 - DNA, 16 bp, Artificial sequence
  Synthetic oligonucleotide
gggcgaggctcctgag

SEQ ID NO: 3243 - DNA, 16 bp, Artificial sequence
  Synthetic oligonucleotide
taaactgaggcctgca

SEQ ID NO: 3244 - DNA, 16 bp, Artificial sequence
  Synthetic oligonucleotide
ccgttgagagctgcag

SEQ ID NO: 3245 - DNA, 16 bp, Artificial sequence
  Synthetic oligonucleotide
accgttgagagctgca

SEQ ID NO: 3246 - DNA, 16 bp, Artificial sequence
  Synthetic oligonucleotide
tgggcgaggctcctga

SEQ ID NO: 3247 - DNA, 20 bp, Artificial sequence
  Synthetic oligonucleotide
ccttccctgaaggttcctcc

What is claimed:

1. A compound having the formula (SEQ ID NO: 449):

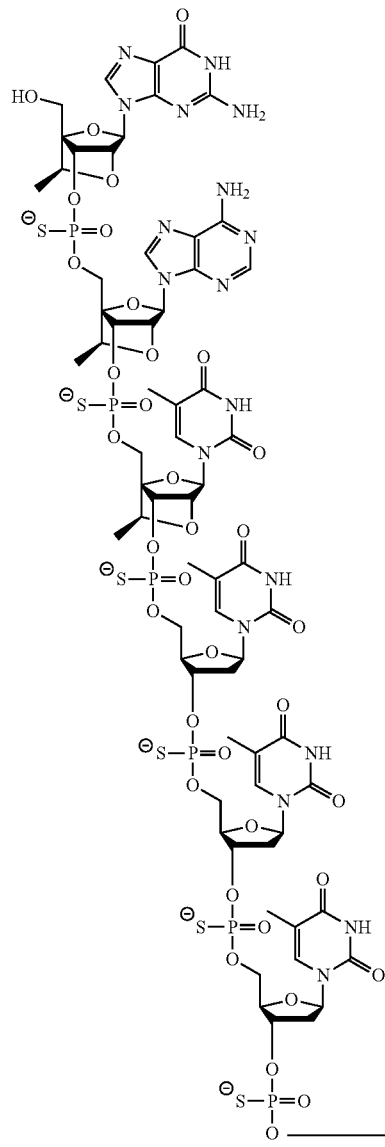

-continued

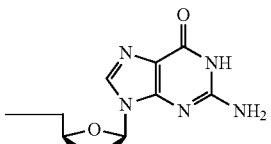
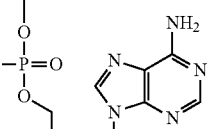
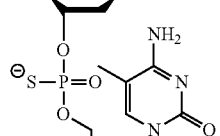
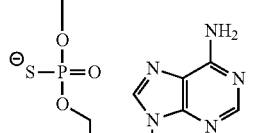
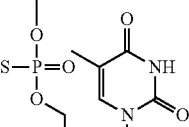
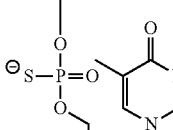
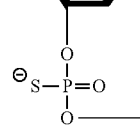

or a pharmaceutically acceptable salt thereof.

2. A compound having the formula (SEQ ID NO: 449):
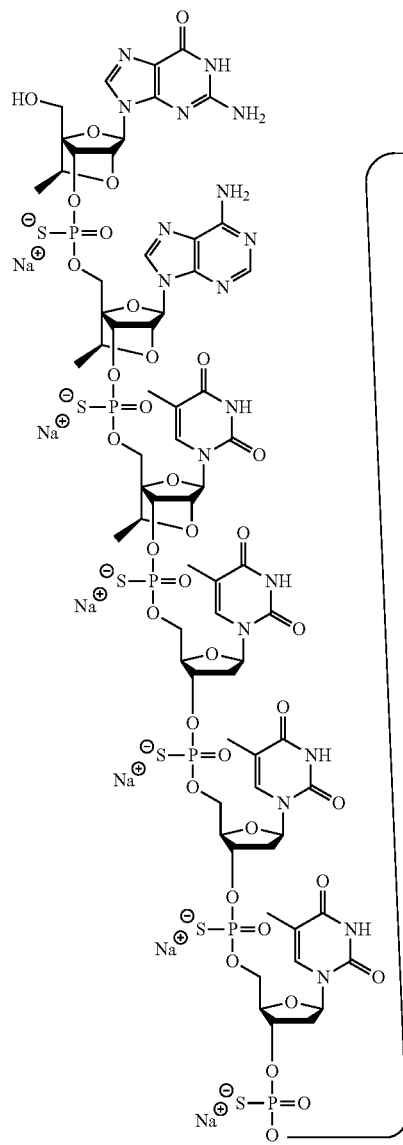
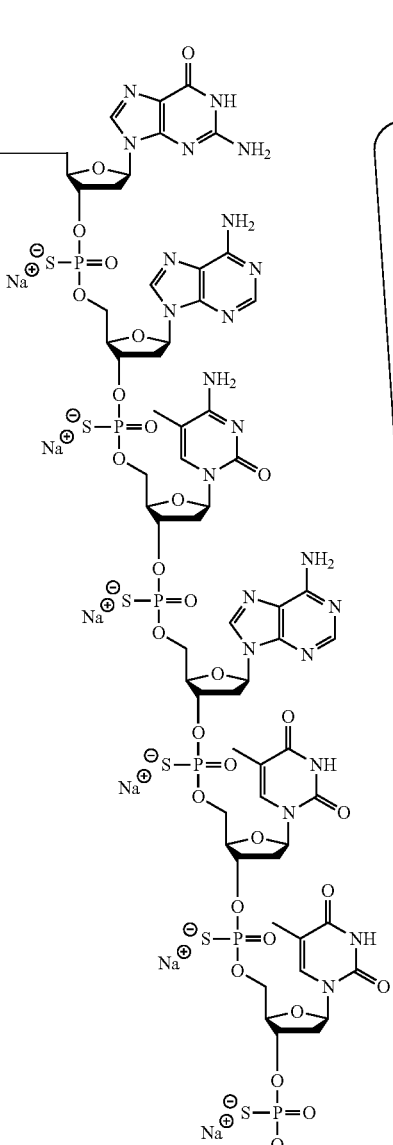
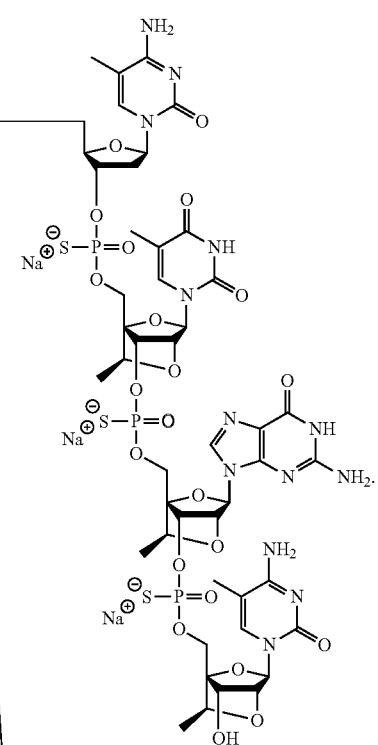
3. A composition comprising the compound of claim 1 and a pharmaceutically acceptable carrier.
4. A composition comprising the compound of claim 2 and a pharmaceutically acceptable carrier.
* * * * *